United States Patent 9,127,276 (CONJUGATED ANTISENSE COMPOUNDS AND THEIR USE) - sequence listing, part 2

SEQ ID NO: 11 - DNA, 20001 bp, Homo sapiens
  misc_feature (1)..(993): n is a, c, g, or t
  misc_feature (2653)..(2743): n is a, c, g, or t
  misc_feature (5539)..(5563): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttggccctcctaattgggtgttctcagtgaaaacgaggacactgctaatatgctttagaaaatagccctcacattctccctgttcccaatcccccacttactctaagctccccaggtagcaataattcagaagtcaaattgctcagcactcctatggttcaagtgattcttgtgtctcagcctcccaagtagctgggactacaggagcccaccaccacgcccagttaatttttgtattttttagtagagatggggtttcaccatgttgaccaggctggtctcgaactcctgacctcaagtgatccactggcctcggcctccaaaagtgttgggattacaggcgtgagccactgcgcccagcctcaaccttctagtgaaccctccatgctctgttatcttttattcctcttggatttttgttgtttcttttctttttcttcttctttttcttttctttttttttttttgagatggagtttcattcttgttgcccaggctggagtgcaatggcacaaccttggctcactgcaaccttcgcctcctgggttcaagcaatttgcctgcctcagcctcccaagtagctgggattacaggcatgtgctaccatgcctggcgaattttgtatttttagtagagacagggtttctccgtgttggtcgggctgatctcaaactcccgacctcaggtgatcagcccgccttggcctcccaaagtgctgagattacaggcatgagccaccacacccagcctttttgttgtttcttctgagagatttcttcaactcaattttccaacccttctattaaattttttaaattccagatattctatttgcagccggcaaggactcttcctgcgctctgcttgttttccaaagcattccgttctagtttttatgggagcatcatcctttcatgtctctaaggataatcagagtggttaaaatgttcttgaagttttcttctgttccctgcagtagctctgtttcctccagtttcctctttcccaagtgattggtctgtctcatatacctagaggtcttgctttgcattcacatctaagggcaaaaggcgctaggatgcagtgcggaggtccattcgctttgtcgtaaggtttgtgcctttcttagtcctgcagtggttgagtaaaacctgaccatcccacaccctcaaatactaagtgcccctgggtagtgatgtggaggggccttcttattaatgtgaggaaatgcttgtgttataggttgtggtgagaaacgctggttacaaaactatatcaaagtaaaaatgtattaatgcacagtaaagacacctggaaaaaaaatgccctttaatgctcacagaaggtctctccgaggggcagccccaccaccctcctgtttcccttcctgcatttccacgtttttctgggcccagatgcagcctcccctcccacccctggtccctccgccttggcttccggctgtcgctttcatccctcctcctcatcagccccttgcagaactccagggtggggcttctgagtctcgctggcagtatgggctccataagtcttgctggacaccgaaattaagttctgcaggtgccgtctccagaatccccagcacagatagacaaacccacatctcaggggtggggggtgcagacctgcccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagctgccctctgtttatatgtctcaccaatgtcaagggaaaccagaactggatagcagttgaaacacatattttgttcgggactattgtaataggggaaaaaagattttagtatagacctgggctcaactctcaatgtggcacaggcaagtggggatttagatctgaggagcagggcggggtcagtgggtggaaaattactggcacgaaacacctgtctggaggattctggctaaacccaggaaacaggaagcttgctgagggcaggcagggttagcagacatcgcctgggggtggcggaggctgagaaccctacccaggtaaaatgaagcttgctgacggcagacagggttagcagacacggcctggaggtggcagaggctaaggaacctacccaggtaaaacgaagcttgctgacggcagacagggttagcagacacggcctggaggtggcagaggctaaggaacctaccaaggtaaaatgaagcttgctgaaggcagccagggtgagcagatattgcctgggggtggcggaaactgaggaccctacccaggtaaaaggaagcctgctgaaggcaggcagggtgagcagacattgcctgtgggtagcagaggctgaggactctacccaggtaacaggaatcttgcttaaggcaggcaaggtgagcagacatcgcctgggggtggcggaggctgaggactctacccagataacaggaatcttgctgcgggcagccagggtgagcagacgtcgcctgggggtggtggaagctgaggaccctacccaggtaaaaggaagcttgctgaaggcaggcaaggtaagcagacatcgcctgggggtggcggaggctgaggaccctgatcagatatggggggatggaggcttcttgccaaactgacttagcagagttcttgctgaatctggattttataaggcagaatgcagatgagcctgtgagaaggttctgaagccggactacagtttggtcaagcaaacaatcttgtcatggattcagtcatataaataagggtcacccagcccaggggaggtgccccaccccatctgttccctctccctccccacactgagtccgaacctttcaggctttgcccccttcacacactccaaatttattcttctacttctcttcctgcaggtaccagactccggccacccagcgcttacctgggactgctgggcctctgccccgtggggacctgtcctccaggaaacaaggccagacacaggagggcagggaggactcttctccagggccggtgcgccgtctcttcagccccatggcacttgacttaggcagagcctacagcaccctcaccccagtccctgcagccaccaggaggtggtccccctcatcccattagccatcaccgccattcacagaggtctcggactgaggctggcagggggagcaccatgacccaagatcagaaccctgttgtctgtgcctctggagaggtgggggcaggagctgagggagggtttgggtggagaggggagaagatgcagtagcaggagcagatgctggcaggtagagacaaacttttatgacctttgccttctgacctttgcctctggccactgctccaactaaaacagaatggccccctctgggaacagggcttcctatgggctgggaagcatggagcccccacagtgtggctatgcaggggagtgaggaccaggtgggggcaggcctgtgggggtcacagagctgggctaagcttcagagggaagtggcccctgggagggggaatggctggggttaagaccctgggttcccacgcccccaaaacagaagtagaattagggagaaaggacccccaagaccaaggacggcacctatcagaggagctctccacgggcaggaggtgtcccagggtgagggtggccaggacaggtctagggaaatgcaggtggagcaggacccagagatggattggagatgccggaggggaggcttcctagcgggagcggagacaggcactgcagacaagtgtcagcgggaggggctctgggtggggaagaagactgggacttggaggaagacctctccagggagaagggaggagggggaaggagaaggggaggaagtgggaggaggagagtgctcatcctggaagccacagcctcggagagaactttctagaaggaaggcatgaccatcagtgtcccaggatgctgagaggccaggaaaggtgaggcctcaaggcgccatggggttgtggtgaccccaagatcactgggcacagagcagggatggctgggggtggaaggggaggggcgcgggctgaggttctagggccccaaagccaggtgtgatgtggctctagggggagtgaggaaggggagaatgtccctctgagcgtgcctcttggggaaggcaggggttctggctggggcttctccactcccaggaaaggaggtggtgtggaaggagcgggtgggacggaggagagagcgccccgcggccgcaggaccagcaggtgggggaccagggtcagcgctgctggaggggccttagcgcgacaggactggccagagaccggggatgtggcacagaaagagttaaagggcaccccagggaccgccctgccggtccacccatgtcacccatgttggcccctactccagcccccgtctgctctgcaggggaaggaaccgggagccgcggtgggggcgactgggggtgtcggtctttccagaaaatcaggcaggcatcaggaaagaaggggcgagaacccggggacgcgagaggaagggggcgagggggnnnnnnnnnnnnnnnnnnnnnnnnncgcgtcccagggcgtcccctcccgggactgggacccaccgcgaccaccacctgctgggccagggtccgcgggctcaggggtctgcaggattagggtctgcggaaccaggacccgtgggacaaaggtctgtggggcgcgggtccgcggggtggaattcagcgcgccgagtctgcgtatggccggggtacgaggcgctccctgcgcagggtgggcaggaccgaagctcgccgggagctgcgcggagggcgggcggggaccctccggtgccgctcccaccccgcggggccgcccccgagcccgccctccgccgccgccctcgccctcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggacccgaggggacgttggggagtcgacccggtggggacagagaccgcggggcgggcgcggcggggccgggggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccggcaagcgggtcactgccctgcccggctccggcccccccggcgccccaccacccggccgactcggccaccgggcttatgctccgactctgaaccgactgaccccggccccctcggcgcccgcatcctccaaggaccggccagggctgctctctgcccttggtattggggacatcagggttggggggtctgggtgcacccacgcctgccccgcccccacggggtgagggcgcagggatagggctttgtcaacagcctgtggcccctgatcccgccccggtgccctgaccttccactaccttctctggtttcacaaaaacatcccggctcccatcccggagctcctcaaagcgtctgagaggccccttgcggacgccctgggagccccgctgccttcctggaccagtggccgctccacccatcctgggggcccagctccaggtctgcgggtccctcagccgcccccagtgggaatcggtggagcctgacgcagccaggagcgcccaagagtcacgtgttctgccagggaggacatgggacaggacacggggtgccagccctgcaaagcggccggggcagtggagctcaggtggccctaagccctggtggtggctggtgtggcccggcaggcagctgtgggagggaggaagggggtggcatgcggtgggggtctagagaaggcgggcagggcacctcgggagcccccccattgggcacctcgggaaccccccacattgggcacctcgggaaccctcccattgggcacctcgggaaccccccacattgggcacctcgggaacccccgcattgggcacctcgggaaccctcccattgggcacctcgggaacccccctattgggcacctcgggaacccccacattgggcacctcgggaaccccccctattgggcaccttgggaacccctcccctaattctcagctgactccaaggcctgagaaggagcttggtcacctggactgtgaaggtggagggtggggtccctggtgggtcgtcccacctaccagctgtgtcgccggaagggtaatacggagcactgtggccccggggagccccgagtggcagctccacagctgggagtttctgtccactccttcagtcaacaaacattgatcctgggctgaccggggcccgggggtgtcagtgtctcctctcgggggagagggctgggtgagatcaacagaggagcctcccttcttcccttcaggctggtgtcaccttcagtgatggggcagggtccccacttgggaagttaaatcgtcgtccccgtcccaggaccacagcagcctcagccctgctctccaggccaggctctctcatgggtgctcagctggaaattggtccccccccggctccacccacccctgttggggtgaggagctggagtctccctacccatatgggacccaccacccgcagggaacggaggacgctcacacttctgcacctcctgcctcactatcagagacccagtggagaattgcctcccacctcacctcttgtattcagaggccctgacccctagggatccgggactaggggtgccctatggggagcccacctgtggcctgtggatgctgagctgtcgggggaatcctccaggatccccagccccaccttcccaaccttctgttgaggctgaggggacacagagccccactcctgggtcctgactgtttcaaagaaaggcctgggggactgggcagccaacccctccctcggctcgctggggtctccagactggctgcccggctggaaggtggggccctggcacgcgaggacctcatgtgtggaggcactggcttggggggtgctcccagtggctctagagtcaacatgacaggcatcgaatggctcctgtttctctggcagagttggggcagagccaggcttggccacgctgggctctaaggggctgtcattttgcccagggagctcctggctgggtggtcctccccccagggtgagcacgcgtcccccccacccccacttcgaggcgcccaggcagggaacagctcattggccagtgtccttcctccttgtcccccgcctgcatctccaccatccaccctgctccagctgccccttgtccctctccccgtcccctgcccagagccccaggtctcccctgcacccctgagcctgcccacctagcagtgcccctcgtccagggcccctctgggttgggggtgcacacagtggggagaggcggctcctgctgctcctcacccagcccggctcagtggccggagccgcccaggacagtggcagtagatggggctgtttgatcaggatcagggaagataaggccccttgcgtgaccccagagctggggacgccaaaactgcccctcctcccccacccgcctgccgctgtctccgccagggagaggcccctactctgtgggtccttcgccccagcaccaagcctgcatggctgctcacctggctcaggaactggggatcagcgacacacgggtcctgcctcccatcggcccctacatgagcccagggtccaagggctgcggttgggagctctttagcagtctgtgacgcaggtgcctgtccctgtcattcagctgtcacactgcttggggcatctcaggccccgttagcggggcagccctgggtggagctggccccacgcgggctcacccagccgctacctggaggaggctaaaatccaggctgtcccgtggcagccagcagtccaggcctgcccggaaaccctctgctccagctgcagccttcgcccatctccttgcccctctccccggcttccccctggcactgccttccagctggctggccctccatctgcccagccatccatccacacctcttattccatttgagggtgccccaaagaagagcccgtaacagcccgggggctcatagccagccactcgcgggaccccgcacatgcacgtggacccacaggaagaccctccctgcttctcccacagaattcagttggtgcagaaactgggctctgtagcaacgaaaggccgatttgtgtagctgttgccaccccgaactcccagctcagatgctggctgtggcatggggaccaggggctgtgactcccacagccctggcaggcaccacgggggatgtcctccccaccctgtgcccccaccctaggccagctcctcctccaagtcgacgcccgcagtgctaacctcaaaggactgtgcagccagcctgtggcgtcccatgggatccaggaagcccaaccgagccttgcacggcacccacgaggcacctaggcaccccggtgctgggcagggggcacacatgtgacacagacccctgagtgtgggccccacacacttggcctggcacagctgcaagccagcccagccactttgctcgctgtggcactggggccaagtgatggaaggtccaggcaccgccaccctcacgcttggcacattggctcaggtcagcctggcaagccagctttcccaggggctaagaataggtgaggaggatggtgaggaagcagccgggggctgtcaactgagggaggaggtcaccatctggggaggctggtcccccacccaagagcattgggtcaccctgcaggaaggtggctgccaccagcaatgagacgaggggctctgcgaccctcagagctgccagccagccagccctgggtggcaagagtgactcctcctggggtctcctccctcctatcgccctctttttttttttttttttttttgagacggagtctcgctctgtcacccaggctggactgcaatggcgcaatctccgctcactgcaagctctgcctcccgggttcacatcattctcctgcctcaagctcccgagtagctgggactacaggcgcctgccaccacgcctggctaattttttgtatttttagtagacatggggtttcactgtgttagccaggatggtctcaatctccagacctcgtgatccacccccctcggcctcccaaagtgctgggattacaggtgtgagccaccacgcccagcccccagctccctctttatccctaggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccaggtgaggactcacagcaccctcagcacccaggggccctcctgtgaggactgcacactgatggctctctgtctgcctgcctgcctgcctgcctgtctgcctgcctgtctgtctgtctgcccgtctgcctgcccatctgcctgtctgtctgcctgtccgtctgtctgtccatctgtccatctgcctatccatctgcctgcctgtctgcctgtccgtctgcctgtctgtctgcctgtccatctgtccatctgcctatccatctgcctgcctgtctgtcggcctgcctgcctgcctgtctgtctgctgcctgtctgtccgtctgcctgtctgcctgtccgtctgcctgcctgtccgtctgcctgtccgtctgcctgcctgcctgtctgtctgcctgcctgtctgcctgcctgtccgtctgcctgtccgtctgcctgcctgtctgcctgcctgtctgcctgtctgcccgtctgcctgtctgtctgcctgtccgtctgcctgtctgtccgtctgtccatctgcctatccatctgcctgcctatctgtctgtccgtctgcctgcctgtctgtctgcctgtctgcctgtctgtctgcctgtctgtccatctgcctatccatctacctgcctgcctgtctgcctgtctgtctgcctgtctgtctgcctgcctgtctgtctgtctgtctggttgcttgtgcatgtgtcccccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttcatgggaaggttcctgggtgcttatgcagcctttgaggaccccgccaaggggccctgtcattcctcaggcccccaccaccgtgggcaggtgaggtaacgaggtaactgagccacagagctggggacttgcctcaggccgcagagccaggaaataacagaacggtggcattgccccagaaccggctgctgctgctgcccccaggcccagatgggtaataccacctacagccccgtggagttttcagtgggcagacagtgccagggcgtggaagctgggacccaggggcctgggagggctcgggtggagagtgtatatcatggcctggacacttggggtgcagggagaggatagggctggaggactcacccgggaggcagtgcctgggttcggatgagggaggcagccaccactgggcagaggggggcaggtgtggcagcctccattgggcagagggagcagatgtggcagccacaggtttggcgatgcacctgggaaggatgaaaatggcattggggttcagcccccagagagggaggtgctgagagaaggtcacggagaatgggggaccccagtgtgggtttggggcacatttgagatggggggtctccaagggaaggtgtcctgcagagctgcaattcagggctgggctgggcgtgctagcggaggctggtccaggggaggtggatggtcaggtgaggaaggtggaggtcagatgggggaggtggaggtcaagtgggggagggagcagcccaggccatgtcctgggcgaggtgacggccgagctcaggcttccagagagaggagagaggcctgctgagggagccccttctcccaccctgccctgccctgctctgccctgccctaccctaccctgcagagctggtgtgcaacagaaccttcgacaagtattcctgctggccggacacccccgccaataccacggccaacatctcctgcccctggtacctgccttggcaccacaaaggtacccatagaggggaggaactgtggggggggcgggcccagggtggggctgaccccagcctccccccacacccccagtgcaacaccgcttcgtgttcaagagatgcgggcccgacggtcagtgggtgcgtggaccccgggggcagccttggcgtgatgcctcccagtgccagatggatggcgaggagattgaggtccaggtcagtgggcggcaggcaggcgcggtggggctggatgggaacgggcatgggggcccctgcctggccctcacaggccactgtaactcgcagaaggaggtggccaagatgtacagcagcttccaggtgatgtacacagtgggctacagcctgtccctgggggccctgctcctcgccttggccatcctggggggcctcaggtaggattccgccagcgcccggggcggccgcagaggacagggaggaggacgggcgctgactggctgtgcccacagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtgggctggcatgagagggggttaaggcaggctgaccaagcctttgggaccacagctgctgccccccacaggtgcccccatgctgttcgtcgtcccctgggcagtggtcaagtgtctgttcgagaacgtccagtgagtatgagcggctggacagcctggggagggaccggggggctggggtgcggcgctctggcctgaggcagggaggggccggggatgagcctggtgcctggggagggggtcatttgtgaccttctcccttccttttctgagacccgaattagatcctggcaaaatcgggacgggggtgctgaggggcggaggggctgggggctgtgccccagtatgtgagtggcctggcctcgcaggtgctggaccagcaatgacaacatgggcttctggtggatcctgcggttccccgtcttcctggccatcctggtgaggaaatgaagagccaggagcgcaccccaggcccctcctcccttggcgtcctgaggctgccccaggagacagcagcatcctgtctgagagcgctgggagggagccggcacccagacaggacaccaggacactggccagcaccctggacactgagccaggctgttcctccctggctgtgtgcccaccagccccagggctatgtggcccagggcctatcttgctgccaggcccacctgcaggagggtcaggtggggccttccaagggcacagagctgttccctggggctcgggatgcccctgactcgcacccttctcacacagatcaacttcttcatcttcgtccgcatcgttcagctgctcgtggccaagctgcgggcacggcagatgcaccacacagactacaagttccggtgggtgccgcggcagctggcgtctcgagacctggagaccctcagggccagagggcagctgggggtggggactccaagctccacgtggatggtgcgggccgagggtgggggcggtgggtgactcaggcgctgcctctgcaggctggccaagtccacgctgaccctcatccctctgctgggcgtccacgaagtggtcttcgccttcgtgacggacgagcacgcccagggcaccctgcgctccgccaagctcttcttcgacctcttcctcagctccttccaggtgcccgcccgcccgccggctcccccgcccggggcgcagtgtgccacccctgaccaccctgtctctccagggcctgctggtggctgtcctctactgcttcctcaacaaggaggtaggtgggagtgggggcatctgagaccatcagcactggccgtcggggtcaggggcagagagaggcacagggatgccagccccacccctgcccgggggttggaacacgtggggcccaagcctttccctccccctgctcttattgggtgcagttgccatggcgctgggtgtcaggcccccaggacaggttggcctcagccccatcgctacggtgtccaccgtgggggtccccaggtgtctgcagactgctttccgtggcgatgctgggtggcatagctgtgcccagcagggagcttgtgtcgctctgcacccctcagagcggagactgggcatctccgatgaggcccacagcaggtcccggtggggtggagaggacaggcaggccctaggactggcctgccccgtccccctccccaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtgcatgtcctggaaagcagggctggaaatgctggggccgaagcagtgggggatggaacagcggtgggtggtcagcgccagtgcgggctgttgaagggtccccctgctgtcccagttcactcagagttggcactggaaccccggaggatcccgaaggcagccagcctgtgcccatctgagcaggtcctggccaccttcccatcctggttctggcgggcagtccccctggacgctttggccaccagagggtcaccattcaccagcagagacgtgaggggcacagtggctaaggcggcatgaggcatcacagtcccctgaccgaccccatcagcactggattcacccgagggcgtcttctccctggaggccgtgaggacactggcacctggctcatcggcccgcccttcctctgagcctcctggcctccgtttcatctcagctccagccccctcgggcaatttacaggccacgtagcagattgaagcgggaagaaatgggcctgaacattgccgcgggtccaggcgacggaggagggcaggttgcccaacttctgcacaggacccggggtgcgccacacacacgccagtcctcgtgccacacagagaggtccggcctacgccagtcctcgtgccacacagagaggtccggcctacgccagtcctcgtgccacacagagaggtccggcctacgccagtcctcgtgccacacagagaggtccggcctacgccagtcctcgtgccacacagagaggtccggcctacgccagtcctcgtgccacacagagaggtccggcctacgccagtcctcttgccacctcgtggtgggtgggcgccctgcttgccagccagggagcaccaggaaagagctgcctcctgcgtgctggacacaggaggtgcttcagggtggggtctcccattgtgtggggcccaacctgagtctaagggcccagggaccacacagcgggggtggagacaaattcagggtagaagctgtgaggggcctgtggtcagccccccggggggtccctgcagcaggcactgtgagacctactgaggtgtgtgcatgggctggggaaggagccagtcaggtgcccctgctctgaggagctgctgggaagtgctgctgggccctgggggaaggggtgctcacagcccctgcctgggccacgtgggctggagccgctcaggcagagccggactaattggggcaaatgaggggacaggaggcctctgaggaaaggtaaatagaattactcacccgccaggcactggggccctcctgggggggccctcaccctgccacccaccacagggcctgcatgcagcagggagggaagtgagctgattaggcaaggctggacccttctggggccctggggttgctgtgattgggacggcaaggccaggagacggtcccctgagctgcacctgctggaggcctgtgatctcagaccttaaggcttcaggccagctctacgcccctccggcctcaggtcctggctctcctctgagccctggatgcccgggtgcctgtgtgggcacgaggctgctccgagtcagcacacggaggtggacattctccttcatgccagctgagctcagggctggtgactgccctggggaaactgcccctcacctgggacctcctgacagccctccccattcccgagtccctctgcccttgtcctctttcacctctgtcccgccctcatccctaagggaactggagcaggctggtggagttgggtggagttggggactggcagggggtggactcacccaggcaataaacactggccctaaccaggcagtcctgcaggcaggtaggtggagggactgttttttttcttttttggagatagagtctcactctgttgcccaagttggagtgcagtggcatgatcttggctcactgcaaactccacctcccaggttcatgtgattctctgcctcagcctcccgagtagctgggattataggcgtgtgccacgacacctggctaatttttttttttttttttttgagacggagtttcactctcgttgcccaggctggagctcaatggcgcgatctcagctcaccgcaacctccgcctcccaggttcaagcgattctcctgccttagcctccctagtagctgggattacaggcaggtatgtgatgcccggcatcccaaaggggtatctgcaagagttgggtgctgtgtgtgcatggctgggaggaagatgactttgataccctggaatctggtgtctgtggacacaaaaatactactaaaatgagagtggagaccaggaaaaaggaagacatgaactacatgaaggaccaaatctaggagagtcagaagtgcgtcacaggaataggggaccttgagccagacagaaggctcagcagagacaccctcaaggggatgaaagggattgagtgcactaatatttagaggagagagttcaggacttgattagtgactagtacatagaaaactaaacaaatgaggctgggtgcagtggctcatgcctgtaatcccagcactttggggggccaaggcgggcgaatcacctgaggtcaggagttcgagaccagcctggccaacatggtgaaacctcgtctctactgaaaatacaaaaattagccgggcgtggtggcgggcgcctgtagtcccagctacttgggagcctgaggcaggagaatcgcttgaacctgggaggcggaggctgctgtgagccaagatggtgccattgcactccaccctgggtgacagagcaagactccgtctcaaaaaaaaaaaaaaagaaagaaaaaaccaagcaaatgaaaaaagaaggcaattaataattccaaagaaaagaaaaatttgggcagaaaagaacaaaacaagcagaatttaccatgactcagttctgaatacaaacacagacatcataatgtaaacaccaacactgatgcaaccagaatcatgggagaaaaaagatctagggagggtggtggacgggaatatcacgtatgtactgggggtaggggagagaacaaaatgggaaaaatcaagaataattcacgttagaaataaaaatacagagcaaaatttaaaaatgcaaagaatgaggtgaagagttcaaagtggtcacctcggggccgggcgcggtggctcacgcctgtgatcccagcactctgggaggctgaggcgggcggatcacaaggccaggagtttgagaccatcctggctaacaaggagaaaccccatctctactaaaaattagccaggcgtggtggtgggcgcctgtagtcccagctactcgggaggctgaggcaggagaatggcgtgaacccaggaggcgcagcttgcagtgagccgagatcgcgccactgcactccagcttgggcaacagagtgagactccgcctcaaacaaaacaaaacaaaacaaaaaaacaaagtggtcatctctaggcaaggtgggtgggagatggctagggctgcaggtccactacgtgagctggctcagcctatccccagacaccctgcactcactcagcccggggtcctccccctgcactcactcagccccgggtcctcccctgcactcactcagccccgggtcctccccctgcactcactcagccccgggtcctcccctgcctgctctttctctgaccctgccctccactgttcctttttcttctttctctccctgttgtgtccaggaaccaggcaccaccctcatttcttcttgatcaatctttaaaaaccagcagtgctcagctaactcttcatctatctcccccgacctggggctctgctgaatccacgctttagacccagctatcagctcggcatgtacagctggatgtccacaccgagctgctcaccctgtccccagcttcttcctcccactgtccactgcagaagcctcctaacaggacccctgctgctaccccggaccctgcaacccattcccacacagcagccagatgctttgacacccgaagtctcctatgaatccgatgaggcctctgcaccacacctcattttacagaagtacaggggaaacaggggtctgttgacaccacagagatgcagctggccaaaggcagaatgtggggtacacgactgtcaaacgccaggggtccttacacgaatggtggaaaaagaggggcatgttacggatggaggctcgggacacatgggcgccgccttcccatgctgccagcaacccaccaggaacctatta

SEQ ID NO: 12 - DNA, 3182 bp, Hepatitis B virus
aattccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtgg

SEQ ID NO: 13 - DNA, 3318 bp, Homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 14 - DNA, 78001 bp, Homo sapiens
cagattccgggtctcatccctagaccaaagatatctgaatcatttggcgatgggtccaggaacctgcattattcaacacacttcccaggtgaccgtaaatgtcaaaagacaaaattacaacaaacttaaacatcttaattggcttcattcatgattctagaatcgggcaagacttcattcctcaaaatagcacaagtgtcccaatgagctgagcagaggaggttggttttatagacagaaaagggctgaaaaaagcagaaacaaagaacaaaaagcagattggtcatttcaaagttactttccttgtaaggcaggaacagggaaacagaacaagagagaaataactgattggtcgcatcgggttacttcaggttactttttgttgtaaggattaaagcaaagggaacttcattatgttgattaaaacggtctgcttgggaaatcagggtgtgtatctctcttctgattttgtgaaaggttatcagtctgatgatgtagaactttagcatgagtgactccattttgatttttagtctagtctgttgagaccctaatgccagaactttttttgtttgtttgtttcgctcttgttgcccaggctggagtgcagtggagctatcttggctcactgcaacctctgcctccagggttcaagcgattctcctgcctcagcctcccaagtagctgggattacaggcatgcgccaccacgcccggctaatttttttttttttttttttttttagcagaaaccgagtttcaccatgttggtcaggctggtctcggactcttgacctcaggtgatccacctgcgtcggtctcccaaagtgctgggattacaggtgtgagccaccacacccagcccttttttttcaagacagggtctctctctgccacccaaggtggagtgcagtggcgccaaaacagctcactgcagcttccacctcctgggctcaggtgatcttcctgcctcagcctccccagcagctgggccccaccacaccggctaattttttaacttttagtagtgacgaggtctgattctgttacccaggctggtctggaactcctggcctcaagacatccgcctgcctctgcctcccaaagtgctgggattacagatgtaagccaccgcgcctgggctcctatgatttttatttaacataatgcaccatggaatttgtgctctgcttagttcagtctgagcaggagttccttgatacttcgggaaacactgaaaatcattccatccccatccattcattcctgcagcacccaagtggaaattctgcgtttcagacagggacactacccttagagagcagtgggcttccccagcagcgtagtgaaacatgatactcctgagtttcatgaaaaaagggcagacatctggccagagctgggaggcaggaaatagagcacggtgccctcctcccatactccagcttggattactgaggctggggcccaggccctgcaggaaaggaggtgcatgactactttaaggccactcactctgtgactcaacgggccgggtcggggctggaactcaatgccctcccgggcctggagagcccacgcgccgtgggcggggctcccggggtcgcctaggcaacaggcgcgcgccgcgcccgagcccagagccccaaagcggaggagggaacgcgcgctattagatatctcgcggtgctggggccacttcccctagcaccgcccccggctcctccccgcggaagtgcttgtcgaaattctcgatcgctgattggtccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggtgcgggagcgccccggagcgtggcgggcccttcgcttaggccgcttgaacatcccctcagacctccaggccccagactccctctgggtcttgccctctgcctcgctcctactgcttgaggattcgatgggacagcgacgcactgcgtccccccaccctttgtccccggggcgggcgtgtttctcgccgcagcgtcggagcccccttcgatcccccacctcccttctgttctccagctcgggtgatctctcaagccgggggaccgccggtctgtgctctcaacgcgaatccctcgcaccccgaccccgccccctgcctgtccactctttgtcccctggggtgatttagcacccccactatttccttttctggagtggaccacctcagactctcttcctttgtctccctgggggaaaaggttactccccccgtccctccttcacatttcctttcccctagtctcagtgtgcgtcgagtcccagagatgacagtcccctttcccctttctgttcattcatttattggataggagttggcaagcttattctgtgctaggcaccgcttaggcattggaggtggtgtttgctaatcaggacaggcaagatcctagccttagtggggcctagagtcgaatagggcaatcaaacacaaaagcaaataatttcagatagtgacaggtgctgtgaagagaacgacttcctaacggggtacagggtgactgcatagaaggccggctgtcttagagaaggggatcagggaaggcctgtcaaaggaggagacatttgctttgtgagctgaaccaagaggagcagaaagccgtgagaatatggggctaaagaaccttctagccaggaggcctgcggtacccactccattggggccatgatattattctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataagatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaattgtattcagcatgcaactagcatggagtgtgtcagtcttcaattcatttccttcattgttcttaagtttttctgccacaattaaaccccacaagttagtcaaggtgttgagattttcactgcttcttaatggattgccacattccctgaggtagtttcttttggtcttagagaattgtcagggccagcttttctcacctccactgtatggatatttttcttttctaagatcttgaaatcagaagcttttctcctaagtgtaaaagtagctctttgtcatacaactgtagcgttttctgaaacagagttcagatgaccttgagtctaaagtggctaactttccaaggtgtgtatcgctttaccaaaaccattatttttcaaggattcaaagaatgtgtttacaattgatagaaaatggaagtttaaaaaaattaatactttatagcatgttgaaatgagggcagccttatacaaagtcatactttgagcttgcctagcctattgtgatcagagaataatgtaatttttgcttacaacttggtaagcaggtcagttattctaacttattttctgattagaacaaaaagatgtaaaaacttgaaaactattgggaaaagaacaaagagtgaagaggacttttgagtgctgaggaatgtggcagcttggaaaacaaactttttaggcagagattctttgctaggtcagtttgataaagtgagcataaccgtatttttaatctttaatgctaatgaatagcatagatgctaataagcatctaggtctataaaaagtcagctttgatagtgtatatagatggctttaaacattgttttctagcatttaaacactttcaaatcatccggttgcttgattgggcctagctgtctaagaggagagaatgagcccagatgaggaaaagagattgattttactgagctagaatgagaggagagagggttgagtgaatgaaaagaatagctcatgtgctcccctccatctgtagtttaagaggggttgggtccggtgttttgcttgttttctcgtctgtaaattctttgattctctgacaccactcactatatttcattgtgaatgatttgattgtttcagataaaggggactgcaataataccttgtgacatgaaggcaagatttattcatgttagaggcaggctttgtaaaatgggccactcttccaattgacatttgtttttatagctgttttcattatgaaatacaatctaatgcctgactaggttaaaaccatgttgtaacaatagttcactaaaattccttactgatatacagcttatgttgttatattccaaaaagatgaatattaaaatttgccaataatgtttatttaaatactattttcttcagaggaaaaaaaactattttatgcaaaggagaaagatctatacactatgactcacttcacttaaaaaaaaaaagactaacggaaatgacatggagagactgggaagttctagtcatcttgagtgacccattagatctaaatgttcttgtttagccctggtttgagtgaactaaatttaggtgtctgatcagtactttggaaatggtgtaaatgcctttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtactgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagcaggtactttttctgaggcctgcctgagcctatatatattttgcacaatttggcattcctccctacagtgtttatgctgatttgtttctggtaacaactaatactggcaaatcggctgggcatgttactttatgctgcccatattcaggaaaattggaattctagctgggtcattgttcccagatgatgtagtttggcaccagccattccatgttcacattttgagtatccaggagggctggggactttggagtagttggtgattccctctgccacatttcactggttggtcactatggcatcctttccaccacactagtagtctaggttctcagatgttgcttatgagcctgcaatggtttctagtttcacactgcagaaatgagtgaagccggttacccgttaatatggtcccatcatcactagagtaattcattgttctaaaaccagatctgagtctctcactcctctgcaactacttctgattctttcataacacttgtaaagtccaaactcctctttagcatggcagccagcttccagtccttccctcctatgtggcttccattctagccagacaagaaagggcagcgttctccaaactcatcctcgcccttcattcctctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtatgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggcccccaccacattttgagtcatggcctaatgaggtaatttagtattgcctgctgcagtggctttggaagaaaggctggcattcttagccagtagaagctgataccactgatttgtttcacagaagctttaaatataacaataaatttgtgcttggcctacggtgaactttacaggcaacttggaggtaatatgtttgtctctctaagaattgttgaattcctcttccctcatccctcctgactggttctcacaagcctagcgggcctttgcatgtggttggttcataaaatactttttgattttgggatataaaatatagttctccataaaataacgactgttaccaagtctttgattttttttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcagttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgctgtgttgcccaggctggtcttgaactcctgggcttaagccatctgtctgcctcaggctcccaaagtgttgggattacaggtgtgagccactgtgcccggcccagccctttttttaagagaaaaacgtatgacatcgttcgatttactgagtgcttatggttttactaaggcagtaaggttttatggataccctatggtaattagatagaattagtgctctgaagtcagctctgtaatatggactcagagtaaacatggcaaagggacacttaaggtctgcattttctctgggaaataaacgtattctttactactctgaatctagtgctgggaaattctaaatccttcttgaggattaaccacttgaagtaaagttttgggtcccaagtaggcttgtgtccctgtctccttctctttacttttcagatgtttcttcctagagactgaggtatattttacttttacagatgaagaaggaagcctcggctgtgtttgtggcttttgtgggtgagcaacatcacttgcaaagataagatgagcatagcaaaactaggctttcaaaataatttttaaaaatttcttagtgattagaaaaggaaaactcttcccttgtctctgttaagaaacgtttttcgacttttttcctttcttaatggatcttttattggcacttctcttccttttgcagaatcttacttaaaagtcactacgttacattacagcaaacagcttagctaatttttatccagatgggccccggttacaggattgtacactattgcgaatttcttacaggaaagtgaacatcaagtaattattccaaatagagttctcttaagaacgtgagttacttaaaaatgtctaaggatgaagtcacttctgaatataacttcactcaagagaacaaataagcaaactgcatttagcataacatggtaaattagctttaactctccttgatgtttgaacatttgtcgctgttaactactgtttcacttttcaaatagtcagggcttagtttgcttctgtaaggataaagggaaaatacgccttcactgagtcataaatatttttgtggctaacttttgcacagagaaaagaggcctctaagaaggtacccagtgaatttttttttcggggcagggagagaatatgtcattttttggtttgttgttgttgttgtcattgttttgctttgttgtttttactctgaactgaactgtatcttgacagcacttttgaattaagagcattactcttattgttctctactacctggacgccacctccctgttgccatagtgttaaggatcatgctccgaggtggggtgaggcagaatggggccaagatcagaaagttacattaagctacatcaggtttatacaagcataaaaccaaatttttggagcagtccccagaatacaacctggtttagccacacctaaaggttgctcttgaatattccttgagaatccacatccctagaatgctgggtttcaatgggccctttatgtacctatcatggtgtcatttctgagcatttctaaatattccttcatgtcttactgacagtttttcttgaataaatcttaggaatattagtgccattatcagtattttgtttggtctgttcacaccacaaataactacccaggtctgctacttgcccctatttctctacctgctaatgaaaatgcttttgaaagtttgagtaacagtattggagtgtgcacagtggtattggtaggttctgtactcatccttaaccacttgttttcatcctttgtgagcttgaagtttctccaaaaaatttatcacaaaacttatcagacatagttaatacactcagagagagaatcactgaaaaagtagatgtagtttaacaaacccagtgccttttttttacccatgaatacatatttgtcaactaaacctcattttgcaacttgttccactactcgaatggtaacaaacttttggtttcccaatagatttggaagatgttgcttttgaaagtaggaaatagatggctttagaagatggaagaatattttgtttgaagtgggagcgtggtatgtccttagctgtctgtgaaatgcagctgaagatgggtgtgggccttcatctgcatttcccatcttcagtttgaggaggtagttacccttctaaccacttaagaactgcatggtacatgctgttttatttacagggcaaaactgtgctcccgtagtttccctggtgcttgccttcacgttaacacagtgtcatcgtttggcagtgtttatgtgccagggtccatgttagaaggaggaaaggtatagcgaagttaaagggtgcagttggcctcccacctttagttttgtaagtgcctttaaagtttgatttttgtaggttgatcataaggaagtgataagtatgttaggttatttgtggtttgagctaattttagtctctttttacagcttgctttgtatcctttgccattaaaacatgctttctagaaagacaacttttgaatgtaggacacagtctatattctatacttggctacatttcaaaaaatattttctcagtactttggaagttggacagttggaagcatagtgacagtatttaaaaatctttgattccggccgggcatggtggctcacgcctgtaatcccagcactttgggaggccgaggtgggtggatcacttgaggtccggagttcaggaccagcctgaccaacatggtgaaaccctgtctctactaaaaatacaaaattagccgagcgtggtggtacatgcctgtaatcccagctactcaggaggctgaggcaggagaatcgcttgaatctgggaggcggaggttgcattgagccgagatcataccattgcactacagcctgggggacaagagtgaaactctgtctcaaaaaaaaaaaaaaaattaagtgatttctttgctttgtgacacttctacttttccagcaagtaaattatattctttcatacaggtatgaaattcttgttccaagctagtggttaaaaaggcacagttgatattagaggatttgtaaaagattatgaccacgcctgcaatgtactgaagcaaggctttgctgggctgtgtataggaaaccttccccagcctgtgcccttgcttgatagaacattttgctcctaagggtaggtgcctgtatctgtctccagtactggttagtttcacacagaacagttgtgtttcagagctttagtctcaagctgccctgctcccctgaagcagccaccctgagcatgtgcactcacaggaggggacatgtgaggtcatggaagaagacgactcaggaagaagaagacttgggtttgggttctgactctgcctttgactgttgtgggattttgaggagttgcatacaggatctgtaaaatgtagtcattagactagactagacagccatatagcattacctagatgtaactttctacaaagacatggtcacaggagaagaccagagggtggggtgatctttctggaaaaattggggcttcatgccttactcatgctagatatggtagcattatatggctgtgcctgatccccctaatctaaaagtgggacagaactttaaaatttcatattaactcaaattaaaacttgaaaaaaacccattatttccttaaaaataataaaatgccctgtgggggcataagtcacattatattttaaaattcctgaatgccacatggatgaatgtagttccttttgaaattcttcttttgtctaaagaggaatgttggattttgtaattggactaaaaaatcttccatttgagagagaaacagtctgctgcatgttctacccttgttcaggataaaacccactaatagctaacatttattgaattctgtgttgtgcctcaggcactgtgcaaagtcctttacatgcaatgctgtttattatatactgtcaattggtctataacagcaggaaatgtttcaggaggacaatgaggtcccagaccctcagtcttctcctgtgtcctggattcagcttcacaatagcactatggcagtgtggccactgcttcagcttccacatacatggctgtgaagagagacaggggattgtgctaagcctccccgatttattaggacataggaggagagagtttgtagtttttgacctttgcctagttttctaacctctttcctagatgtcacaaattggccacccacagtcatattttgcttgcttcacgcaatgctttttaaaaaagagaagagtttaatttgtgccattgtttataaatgaatcaggagaaatgacatgcaactctggattctggcctctcttgaaaaatctgaaaatcacaccgtctgagcttacactggcagtggtctgctggactgagggacacaactccttttggatgtacatgtgtgcgttgcagagtttaccacagtcccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaatttttttttttttttttgtatttttagtagagatggggtttcatcatgttggccaggctggtcttgaactcctgacctcaggtgatccatccacctcggcctcccaaagtgttgggattacaggcatcagccactgcctccggccaggtatttgtatttttagtctctatgccttaccgtctcagatcaggaggatttggtgatttatcgaatgtgggggaaggggaagaagaggaaacgggaggaatgttccagattagggaaatagctagatggaagatgcagcccctcatcaaggtggggacacaggaaaaggaacgtgtgcaaagaagatggtgatctggttgtgaccatgttgttagaggacgtccagggaagcatctggtaggtggtggggtgtttaaatatagaacattcggagaatgctccgaagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaaggtctcatttagttgttgtgaattttaagggatattttcaatgatgttggctggtttatcccattatgtggtctttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctggtctcgaactcctgacctcatgatccactcacttcagcctcccaaagtgctgggattacaggcgtgagccaccatgcccagcctatgtgctcttattagcaattctcagtacacagatagctttgagtgattctttcaagtcaagtaccttattaaaaaactcaagtgtactgataattatcttacttttaaatggctaagtgataagactgaatttttaggtactgtaacacttcagattacagattctgatatttttatggttatttatatttatttatttttgagatggagttttgctcttgctgcctaggctggagtgcaatggcacgatctcggctcactgcaacctccgcctcccaggttcaagcgattctcctgcctcagcctcctgagtagctgggattacagtcacccgccactacagccggctaatttttgttatttttaatagagacaatgtttcaccatgttggccagggtggtctcgcacttctgacctctggcgatccgcccgcctcggcctcccaaagtgctgggattacaggcgtgagccaccgcacctggcctggttacttaaatttaaatacaaaaattatgttgattaattctgaatgatttcctgattgctccccgtttaccattcacacatttattaaattcttcgcttgccatatagaagcagtctctctgccatatatgccatatagataacagaactagctgtctgcaaaccactgaaattgtgaaaacatctccccttttttcctgtttctaattctagctatgaggattatatacagaagtagtcctggatttgatttttttttttttttgatgattgttttttgatagttgttgactacaaatcatttaaacgtctgaaaggggaaaggttttccttaaaaatggatgacaaaggagaataaaaaggtattttgactatttttttgaatgatgagttttttttttctctttcttgttttcttttggagtcatttatgtgtcactgagtggataccatggaacatgtggcagaagtagatatatggggtaaaagaaccatagttcataagctccttgacagaatcactgaagtgtagccgttatatggccactgtcgcagggggaggcagcagttttgaagaaggggatgagtaataatgagtgataaaaaggcatcctggatagaagaccaaactctgcagaagaccccagtttgattatgcttttgttttctgatttgcggaggagagtgaaaatgcctgaggggtgcgggggagcacatagggtgtatgtgtgtgtgtgtgcgcgtgcagattctctctttcactgtatgtatttgtatgcatgtatgtatcttaggacttaagctttctagtcaataaattgccatagtggggaattgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcatttgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttccagactgagtcttgctctgtcacccaggctggagtgcagtgccgcagtcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagacctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattctcgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgcgtctgaaaccaaatcattgtttttgtttttaacttttttcttaatatattatccttagttcagccctgaagattattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattattattatcattatcattatttttgagacagagtcttgctctgtcgcccaggctggagtgcagtggctcaatctcggctcagtgcaacctccgcctcccaggttcaagcgattctcgtgcctcagcctctggagtagctgggattacaggcgggtgccactacacctggctaatatttgtatttttagtagagacaggtttcaccatgttggctaggctggtcttgaactcctgacctcaggtgatccacctgccttggcctcccaaagtgctgggattacaggccttagccactgtgcctggctgattttttttttttttttttttttaggtttgttttaactggaactttacgtgaatgtaattgaatttagaataaaagcacttaatttcacagtgtgcagtgaactttctgttacttattttaacagtaaaaccccttgcagtaaatgacttggagcaaagattgcttttttaaaaaatgttttaatttgtttttcttttcttgagatggagtcttgctctgtcaccaggctggagtatggtggcgcgatcttggctcactgcagcctccccgcctcctaggttcaagcgaatctcctgcctcagcctcctgagtagctgggactacaggcacatgccaccatgcccagctaatttttgtatttttagtagagacagggtttcaccatgttggtcaggatggtcttgatctcttgaccccgtgatccaccctcctcggcctcccaaagtgctgggattacaactgctgggattacaagtgctgggattacaagcgtgagccaccacgcctggccaattttttttttttttttctttttgagacagagtttcactctgtcacccaggctggagtgcagtgtcacagtcaaaactcactggcagccttaacctcctgggctcgaatgatcctcctgcctcagcctcccaagtaactgagactacaggcatgtaccactgtgcccagctaattgtttttttattttttattttttgtagggacagggtctcgctattttgcccaggctagtctacaactcttgggctcaagcagtcctcctgccttgacctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacggggtttcaccatgttggccaggctggtctcaaactcctgacctcaggtgatctgtctgcctcagcctcccaaagtgctgggattacaggcgtgagccactgtgcctggcagggagtcttatagaagctgtcgtggacaatgtgggaagtagtgagcctttgtattccagtatgctgggctccactgtgcttgctctggcccccggtcgctctctgtgtgttattgagtccccatccacggccatactcttcgtcctgcttctctccttaccatcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctggtatggaatctgtctgtagttgtactttctacctctgtatttaaggggagatctgtaacctaccaatgccagttgaagaggatggatgatagagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccccatagaactatgttaatgatttgtatgtatggtatttaatattatacataataatgattgtatgaataaaaaacattctgggctccatgtggatgatggggtgtgtgtgtgtgtctgtctatgtgtgggtgggtgtgtgttcatagatcccttttcctgcaatcctggcactggaattggttttatcatttccaattaagtttcattcccatgaattttggagtacagactgggtccaggtatgcagggcatagattagagccctgagaaataggattaggctggaattgctgggttggagatcagtagcttccaggaacactttttgggcctggctgtcttcattatccccttttgttttctcctggggtctgcaggtattgccctgttttgttcctctaatatcactttttttttttttctgcttttgaccagggtttttgcctctggtctacaactgaatatcctatcagactctcctgattttgaaataaatatatagtttttttgaggtgttctagcgaatttctaaatctaaatgttgtggcagagttattacatactaattttgctatgagaggttgtagaatcccagatgactaatcttgtaaaccatacacgcatttccatctaattctccattgtatatcatgttgcagaaaataacagcctctagagtttacattgcctcctttgactatatttcttatttaagattagttttcagataagaccttttcatggcagtacataactgtacagagggcttccaacttgtcttgggagctctcatctctgggagacatcacattacccactgccccctgccccccgcccccagcctggatgcactcagcctgtaccccatttctgtcctcagccaaacactgctgaaatgcaagagctttcaattgctagccagtgaagatgcagactaagggatttccatgtagaagcccgctcttttcagctggctcgtcgagagctggaggccccttgcttgttcacatgaggctttttgtccctgacttggtggctgctgtttcacttctcagcagaaagggacacccttgcccccccccagaaaggaagatttgatgtaccacttccgaaaggttcagtcgggcatcactgtaaccaagaagataggtcaggtgaggctggaggtggaacagggctgctcgctagaactccagattgttccacaagtgccttctggcagagaatgatggaagcttccgtgatttttttttctccttaatagttatgagcacagaagaggagcagattgtctggctatagaagctgtcttattttttatttttgtttttgagatggagtctttctctcttgcccaggctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggtcctcctgcattggcctcccaaagtgctggaattacaggcccaattttattcttgggatgtatgtctgaaactctttccttcacttccttcccaagccttagttcaggcccttctcatctgtggtcttcaaagtcgccttcagctggttcaggtccttcctttctgctgtatctttcatgggaggacatgttatgtatcactgtcctacttgaaaacttccattccccattgatgagggtgttacctccagattcctaacacaggtgctgaaggcatgcctggataaaggcactcccttgatctcctggccaggtccccgtacacctgcagcgcatgctccacattctgtctttactgatgctgtgtcttctgcctgcggagccacccaccattctattcacagcccctgcctcagcggagcacgtgcctccctcttcctacactgagctgtcctttctattgaatcccctcttttttgtagtatgggaaatattttattatgaatactcttttctctgttgcctccgtgaccacgttaactttgccctaattcgccttaggactccatctgcttaggggaaagttaggatttggttacagaaagcaagctgctagaaagaacagtgtttagcttctgacaggcaaaataggattttgcaacatgcttttcctttttaatgcttagacattttatatgaattaatatttttatttggttgcttatacattactttctttttagctagaatgtgaaccctataggaacatggggattgcctttcacatctttgtatcctcagtacctaatgttcagtcaccctgtggtcttgtgtcgtatatacatttagccttccttaattaaaccatatgtactggtccccgtcccccacccccaaatagagagaaagaaattccttgaatactacattgccagtatcaaaccacaccttgatatcctctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctataaggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtgattagaagtggcttagcaattctaaagaacacagggaaggcgtgtggccagaacattggtccctagagcacatcgcctcctgacataccatttccttaagttaatgttttaccactatacataggccctcccctttgtttacccagatttttttaattttaaggatgtttttaataacttagaatcctgtaatttgttgaacagtcctgtattccctttacttatattccttgagattttataaaatattttttacatgtcccaagtcttgattatatctttttacctcttgttaagaaatacttacttttctatttttatgctatatttcatgtttactgtagaaaacaaaaaaagtaaaatttttctttattcctatcactgcagcttataagcactctaaacattttgatctatattttgccaatcatatattttagttaaaattgttgttgacataattgtagattcctgtgcagttgaaagaaataatacagagctgagcgcggtggctcacgcctgtaatcccagcactttgggaggccgaggcaggcagatcatgaggtcaggagtttgagaccagactggccaacatggcgaaaccctgtctctactaaaaatacaaaaattagctgggtgtggtggcgggcacctgtaatcccagctagttgggaggctgaggcaggagaatcgtttgaactccggaggcagaggttgcagtgagccgagatggtaccattccactccagcctgggcaacaagagcaagactgcatctcaaaaataataataataataataaataaactttaaaaataaaacagagagatcccatgtgcgctttgcctagttcccccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaaaaaaaaaacagaaatgtgaaaaggaagttgtgttagagtatttggagttgagaaagcatgaaaaggacagaagagaagctggttgtcaggttgcatggggtagctacaagcacactgaccagaaagtcagctggaaaaaaaatgtagaaacaggagataaaacggccaaggggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttgaagttagctaatattcatttcttctcccttctttcaccctcctccagagtctgatttgaagtattcctagctgctacctataaaagcaataagcaagattgttttacttttcacaaactcgtcctgttctgtgcctctgcctcggacatagctgtagtatagagtgttgtctcccttacatccttctatcttagacctactagtaaatattaatgctcactctaagttcttctcaattcttttttttttttttttttttttttttgagaaagagtttcgctcttgttgcccaggctggagtgcaacggcacgatttcggctcaccgcaacctccaccttctgggtttaagcgactctcctgcctcagcctcctgagtagctgggattacagtcacgtgccaccacccctggcaaattttgtatttttagtagagacaaggtttcttccatgttggccaggctggtctcaaactcccgacctcaggtgatccacctgcctcagccttccaaagtgctgggattccaggcgtgagccaccgcgcccagcctcttctctcaattcttcctgaagctctttctgcactagattcctcaggaagggcttgtgggaacaatcttctgtgaatcaacagtacatattcataatagtttgtcagcagcctattattttaaggccatttggtctgtatataaaaatgtttggatcacattttctttctttaaggtaaatatgttattctgttgtcttctggtataaagcattgctgtaaatgtttgacagtctaattatcttttgcttataagtgacttagggttttttgtctatgtgcccaaaggattttttccctctttctctctttttttttttttttttttttttttaaacagacaggatctcaccctgttgcccaggctttagtgcagtgaggcagtcagagcttactgaagttttgaactcctgggcttgaggaacaaaggatttttttaaccttttaattcaaagtctcatcatttatgcaaccatgtcttggtgttggctgttttgggttgttctccctcaaaaatccatgtgctctttcaatatgtagttttaaatcttttttttttaatttcaggaaaatcttgaattagagttttccgtttttcgtctggtacattgcttgggtttccttcttcaggaactcagcctgttatgtgtatgtttgatcttctttgcctgtcgtctgtttctttcacttcctctcacttttttaaacttcatttattaaaaaaaaatttttttttcgagacagagtttcgctcttgttgcccaggctggagtgcaatggcgtgatctcggctcactgcaacctccgcctcccaggttcaagtgattctcctgcctcagtctcccaagtagctgggattacaggcatgcgccaccacgcccagctaattttttgtatttttagtagagacagggtttctccatgttggtcaggctggtcttgaactcctgacctcgtgatctgcccgcctcagcctcccaaagtgctgggattacaggcgtgagccactgtgcccagccttattaaaaattttaaaaacatacatttaaacttaacagaaaaattatgagagagaagggggtggtgccaggcttttttaaacaaccagctcttacatgaactcatagagtgataactcattaccatgaggacggcatcaagccgttcatgaaggatctggccccgtgacccagacacctcctactaggtccatttttaacattggggatcacatttcaacgtgagatttggagggggcaaaactacaaaccatgtcactcagggattggaggagcaagtaccacctatactttggactcaggtagaaaggcaaaatatccaggaaataagctgctaccgtccagggttcagcagaggtgcccatcagcctgccaagtactcaagagtccagcctctagggagctaatcatcatggtgagctcttcgaggcacagggagctgggaagacagtgcttgccacccctgcctgaatagtgtttgcacagagagttctgttgtgtcttgattgggtcctcctgccactgggaatgctgtggattatactaggtctctatctggcttgtttcagggctccatgtgaaaaccttcttgatatcctagccatccacctgctcagtccctagtttgcaaggaggctgtggggagcctagattctgtgtcagatagaatgtactacattccgtctcaggaatgtaccacatcagaaaacagtgcgacctgcaggagaagtagaggtgaagaggcacattcttccgagaaatgtttctctcaacacccagcattccctggatatcagcaggaaattactcactgctagaaaatgccccatgagccttctgttaaggaggtcaagggagagaacagagaaagttctcaaagttgacttggtcactggtactttcttatgcggttcttattttgtttgccatcgtcatcatcatgctatgtctattttctcaatccaaatccactgctttcaccttggttctttctgaccggtttggcacactcattcagtaaatccttatggagagcccaatgtctgcataattgtgctgtgctgatgaccaagctagacctacgagtgtcggctcctttgagatgtacgggacagctcttctgtcatctcttctgggaagcctctccaggcttggtgaacagtggcaagatgtttaacagttgtacatgtgtcccatgttcctttctaagagcctgggcaaaccagacccggtcgcaggtcatcgtagtatggcgtgagcttcctctctcctttctgaccttttgtgtgatggcaagaacctgcagagtgacacaagcagcaggcttctgaggttgctctagcctcagaatggccgtcccttctccaccctggccctcattgctgaggtttcctttgaagcaacagtgccggaacagactaggggaagcagcttggacatagctgtatgatttattaccacccattgaggccaaccaaagtcggcaaggagaggtagcaggtcagtggtgcctggaagcttcctctttcctttgcaccagatgtgactgctctgcaattactcctaaatttgctactctcgtttttactagccaaccttgatgtttttcccttcttcctgtagaatagacttcccctctgatcagtactttctactcaacactatttgtggccacagtgggaactcattgaggacagggaccatgacattactacctgacccatcaacacttggcataacttgaaatgcaaggacaaaaattggctgcaagtacaatgtggtcttcactctgaaggtgatccttaaaacttggctttggcatcatattgccttaatatacctaggggattgggtaaaaccagttactttaaaagagttttacaattctggccttctagctatcttgtcttcttaaacaagagcacaagatgaatgtatcttagtgaaattttatatggtttgctttgagtaatcttgcgaagattgatttttagcacagtaggaaagacacattctaatagtgatttttttccccgagtttatgtactgctgttgcatgaaaatctgactagatttaatgttcctaaagttctttgttcatcctgatttttgcaggtcctagggaaagctttgttttcctcttaacctaacttagatgttgtcatttcatgagctttggaggaagagtgtatagccaattgtgtaatgtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatcttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttttcaatattttcttgtattttactgcaagtttatacacaacataaatatgggggaagggggaaatgtttataccagagccatcctgcccattctttccttacagaaggacaaaggagcagtatttattttaactacaaaaatactattgtaggttttaaaaattccgtatattttgatatcttgtgttcctcttgacctttaatttgctaaatagttgcaaagaatgaaggtaacctgcatcatcttcttaaaaaccaactctatctaattataatagtttgtctatctctgaaaaatagtgatgtgttcattctgaaatcagaactaccggatgcagctgcattttgttactatttgaatttcgggagagggaggaggatgcagcctttcgagctgctgaaatacacaaacacaaagaagacaccaagcatagtagaactgtgttaagctgaccaagccagaagaagcacctattctcagcatagtatgagacgtaaaggcaatataatgggcatagttgaagatggtagaaggaaaatagactctgatggtttaatgttaaatgctttttttaaaaaagtggtattccaatatcgaagaagaagactttctacttttagaagcaataaaggaaattgcagaggaaagggtcaataggttggaatacataaaaattaaaaacttttaaactttttttttttgagacagagtctcactctgtcacccaggctggagtgcaatggtgcaatctcggctcgctacaacctccgcttcctgagttcaagcaattctcctgcctcagcctcccgagtagctgggattacaggcatgggccaccactcctggctaatatttgtatttttagtagagacagggtttcaccatgttgtccaggctgatctcaaactcctgacctcgtgatccgcctgcctcggcctcccaaagtgctgggattacaggcatgagccaccgcgcctggactaaattgtttcagtattaattttttttaaaacaagatcttactgttgcccaggctgaagtacagtggcccaatcatggctaactgcagccttgacttctgggcctcaagggatcctcccacctcagcgtcccgagtagctgggaccacagacatgtaccaccacacccagctacttgttttatttttatttttgtagagatgaggtttcaccatgttgcccaggctggtctcgaactcctgggcccaagcaatcctcctcccttggcctcccaaagtgctggtattacaggtgtaagccattgcgccctgcctgattttttaaatgtgcaaacagataagttggaaaagtgatttccaataaagataaagagttgatggttttaaaatacgtaaagagcttatatgaatgagaaaaacactaacattccaaaagattagaaggcaaaggacagaaagaaacaaatcactatgtctgggaagggacatgaaggagcaggttcccactgggccagcggggctcaaacccactggggacgtccgagagactgcaagggccatgccttcacattgccgtacctgagaagcaaggagctggggtatttatctctttcacactttgggaggctgaggtgggcggatcacctgaggtcaggagttcgagactagcctggccaacacagtgaaaccccgtctctactaaaactagaaataattagctgggtgtggtggcacacacctgtaatcccagctacttggaaggctgaggcatgagaattgcttgagcccaggaggtagaggctgcagtgagcataaattgcaccactgcactccagcctgggtgaaactctgtctcaaaaagtaataataatcatgataaataaaataacattagattgttagcagaagtagccacaggtttctcccacctctctgcaagttgctgagtgtgattcccatcaagaggtacaatgtctttttatttttattttatttattttatttatattgcctatgttgtctaggctggttccaaactcctgagctcaagtgatccttctacgtcagccccccaaagtgttgggattacaggcatcagccactgcacctggcccagatactttttcttgagtaggaatttcgagtcaccctgaacattgcatgccttcgtagtggggaagacaataggaaaccacaggctgtaggctaaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatacccaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcactccactctaggtgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtatcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaattttttagactgttctcttacaggaatggttttgtggttctcagcattttaaaaaaaatagtggttccaatatgttttattgacatcaattactgtaagtctgattcattttctgcctattgatttctacccaaggtgaaattcatgacatttaacagaaagcataagtgattttttaaaagcagacactattagggacggtaaaaataagatttaaagtcgggacacttgaaaaagcaatttttatacctttggtaacgattctattctgattctttgtataaataatataaacaaaggctctagaagcttactataatgaagttggtgtgctgtttctaaattctggtttaaggcccaaattcattttatctgcattaacttttttttttttgagagtctcgctctgtcacccaggctagagtgcaatggtatgatctcggctcactgcaacctctgcctcccgggttcaagcgattctcctgcctcagcctcccgagtagctgggattataggtgtgcgccaccacgcccggctaatttttgtatttttagtagagacggggtttcactatgctggtcaggctggtctcaaactcctgaccttgtgatccgcctgcctcggcctcccaaagtgctgggattacaggcgtgagccactgcacccggccgtgttaaaatttttcagtggtagaccactatgtcaatatgttgctttcactgacaacagtattttcttaaagataggataccccatttctagatgaatctcattctagctggaaaataatttttcagttctgaaactacatcaggcctcagggaatcaaaactagctattagccacacacatataaagtggctttgctttataaacgatttagggtcaccatcaatgacaatggtccctttttattgtatttttaagagtttcttatcttaaatggctgcataactgtagagttttaaaaaaattaagtaaatgaccatgttaatgctctattaagcttccaaacaatattgtaatttactttgaagatttttttttattctcaacatcctgcagcttgaccgtttgcctccgtgtctcagtgctgcttattttgaggtgtggactggagtccatctgtcccccttgcctctgaactgctccgttttgtgtttcgtaattcttcatgctgcatcctgggcgcatttctctgtagtagctttcaatttgctcatgctttgactgggcttagtctagcgtttatcctatctcttaaggttttttaaaaaattttcatgattattcatttatttccaggatttctcatttcttcagtcacatctccttgttctggttttacttcttcctgtttttattcataacatcttttttatacacgattccttcatgtatttctaatcttaagtatatttaattgcttatttgattcttttttttttttattgagacagggtcttactctgccaccaggccggagtgcagtgacatagtcatagctcactgcagcctcaactacttggactcaagcgaccttcccacctcagcctcccaggtagctaggaatacaggtgtgagagccgccacacccagctgatttgtcttactatgttgcccaggctggtcttgaattcctgggctcatgtgatctgcccttcttggcctcctgaagtgctgagattataggtgtgaaccactgcacctggccaagtatgtttatttatttattctaatttgagagggagtctcgctctgtcgtgcccaggctgtagtgcagtggcacaatcccagctcactgcaacctctgcctcctgggttcatgcgattctcttgcctcagcctcctgagtacctggggttacagttgcgtgccaccacacctagctaatttttgtgtttttagtacaggcggggttttaccctgttggccaggctggtcttgaacttgtgacctgaagtgatccgcccgccttggcctcccaaagtgctgggattacaggcatgagccaccacgcttggcccaagtatgtttatttttaaagtccccaacaagctatacaataaattgcatatggaatggatttttgttctagttgatttgttggttatcatttgtagaactaactagttgtcttctgtgtttgataccttgcttctaggtcattttgagttgggagccttttgttttgtttttattctcatgctgtttttgagcctagctgtgcctttatggttttctctaaatttaattgaccattgttttatatttggagcagtgggtgtacatcagagtgtgaaagcagccccaccctctccaccagaaggtctccatgccagtttcacgaagcatttttcatgccctcattcctgcccttatcccttgatttgtggggagtttgtaaagcagttgattgttttttttccacgtagttttccaagtgcacataattgttctgttagtgacttgtagctccattatctattaaccttgccccagaccactgtacaagcggacccaacgcttcctccagctgtggcagggacagttacttggtatcctgctgccttttcaatgctgaccagttttgccccttcctcccctcaacccctgtctttcattcaactatcaccaaaccaaaagattctggtttgctttttagtatgtgttcttattcagtacatagtcattttaaaatttaaaccaaaacagacttggtactgattagcttaattttaagctttttctttattattaaacagtgtagtttatcttagcatttcatattaagtatatgatttatttcatattgcttatatgaatgtacacataaatataataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacactgtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttgtggaccgaggagaagggtgttaaacccagattgtgatgtttcacttgatgaagtgcttaatataaacatggaaatatttccgcaaggataaactggcttttatgcctgtgtgttttcaggagaaatagaaatctctaatcaaatattgccagcttttcacccaagtttgactttttgcctaattgagtttgggaggtgtctgaataatggataatgagctttcctgaataaatataaaaattaattaactccaggctctaattcattctgttaccagagttttgtaagcatgttacccctttgtgttcattgggagatcatctgttaccttcttaaatgagtggggaaggatgggaaatgaggaagagctataaaaactattcaggtgaagaaggtttctgcccctccttgccccttttaaaatctccagctcagcagatgctttgtttaaacttgatcaagtgcttgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaaaccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatataccattctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaacagcatctatatgagaatatacccaagggaagtacagagaggaaaaaaatgtggattggggggtgcctcagtgacatatggaacaatattaaacaagtctgcccccaaaatacttgaaggaataaggttcaagttttttccaggtttaatgaaaactataagcctacagattcaagcatttcaacaaaccttcagcaaaataaacaaaaccacagtaggcctggcacactgtctcatgcctgcaatcccagcactttgggagcctgagtcaggaggattgcttgagatctgcttgggcaacatagccagaccctgtctctacaaaaaataaaatgaaataaattagctggatgtggaggtccacacctgtaactctagctagcctggaggctaagaagggaggattgcctgagcccagtagttcaaggctggagtgagctaggactgcatcactgcactccagcctaggcaacagcaagaccacatctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgcaaaaaaagaaaaacattcaaaagaaggcagagacagaggaaaaaaggaccaaagatcaaatgagtcaaatagaaagcagctaaactagcaatatggcagatttaaatctagccatgtcaatagttatattaaatgtaaatgttctaaatacctgaattaaaggatgaagattgtcagattagattgaaaaagcatgacccaactacatgctgtctgtaagaaattagaaaaagaacaaattaaatccaaagtaagaagaaaggaaatagagtagaagttagtgaagtataaaacaaagagcaaagaaaatcaattaaatgaaaagctggttctttgtaaagatcagtaaaattgataaatttctagctaaactggccaagaaaaaagaaaagacatacaaattaacagtatcaggaagaaaaacagagaattcaaaggagtgtaatgcaaactttatgctagtaaatgcaataagttagatggtatggaaaaaaatgtgaacaatacaaagcagactgtggttgcctttggtggcagtagcggggtgggagtggaaggttgaattgactggaaccagaagcacaagtgaactttttggggtgatggaaatgttttgtatcttggttgcattgatagttaaatggttgtagacattgcttaaaactcactgaacacttaagtgggtatgttttattatttgtaaaatatacctcaaaagcagttttaaaaatgtattcaagtacatacttaagatctttgcattttactctgagtataccttaattttaaaatctgttttttaaaaagtattatgtagataccttttattttcccaatgtctttattaaatgacatctccacgttttgcttcttacctctatttttttttttttatttctctgtctctcaggcatgcacacacacacaccaaaaaaagtacatatgcataatccttttggctgaataaaatcagttgcaactgttatttcggcccttatttgctccgggtaaatattcgttagctgagtggtttatctgtatcagatatttcttacatcttcatccagtcacaccagctggactgaccagattgtttttcacttcaagggcagaatttgtactcactgctgaatgcttccaaatgatacgtagaataacaaatttaagacttagatttttactttttcaggtctttttttttttttctgtgctgtatagcatttccctgaaagcttaatctcatctgtaagtgatgcagtggatgtgttactattggattaatttatttactcttaggtaggtttgtaatctgtcatcatgctgttgtttttttgtgtgggtttgtttttggttttgagacagggtctcactctgctgcccaggctggagaggctagagtgcagtgatgtgtttatgggtcactgcagattcaatctcctgggctcaagtgatcttcctgcctcaaccccttgtgtagatggaagcacaggtgcacgccaccacacccggctatttttttaaatgtattgtagagacgaggcatcatttttttgcccaaggctgatcttgaactcctgggctcaaacaatcctcccacctcggctcccaaagtgctgggattacagatgtgaaccaccactcgagctccatcattctgttattagttgttctctagtatgagtcaaaaactcttacctgcccttttacagttttataaataagtaagcagaatagcagaatgtggacattttttaaatccaaattgaatatgcacatgactcaaggagtcaaatagtaccgtaatcggtttatgataaaatccagtggtttggctgggtgtcgtggctcacacttgtaatcccagcaccttgggaggctgaggcaggtggatcacctgaagtcaggagtttgagaccagtctgacctacatggtgaaactactaaaatacaaaattagctgggcatggtggtgcatgcctgtaatcccagctacttgggaggctgaggcaggagaattgcttcaacccgggaggcagaggttgtggtgagccgatatcgcattatttcagaacaattttccacaagatcagtgagtgctgtccaatagacatataatacaacccacatacatgactttacattttcttgtagccatagtagaaaaggtcaaaagaagcagatgaaattaatagcctgggcaacaagagcaaaaccccatcttttaaaaaataaaataaaatatggtggtttgctgtccccacctcagaccatttctctggtctttctcattgaccaccactcccaatctttgttctgctgattgattacagcttgtatatatctccatatttctaagcaaaatgtttatcttttttaaatttataaattctttttattatttttcagagacagggtcttaactctgtcgcccaggctggagtacagtggcaccatcgtagctcactgtagcctcgaactcctgggctcaagcagtcttcctgcctccgcctctcaggtagctgagactacgctacaggcacataccaccatgcccagctcaaaatgtttatcttttgatacattattcgagaccattattaaggtggatgatttagttttcttaaacagccatcccctttcttttcctcccctctgcttcaccgcccccattttcccaatgttttaccttttggttaaatcagtactcattgtttacattatttgcctctgcacatagtcacagatagtattgtactgtactgtactgtgtttcttttttaaacattatttctgttgttaataattgactttttaatttttttcctattttgttttttaaagagatggggtcttactatattgcccaggctagagttcagtggctcttcgcgggcatgatcccactgctgatcagtacaggaatttccacctgctccatttccaacctggaccagttcaccccttcttaggcaacctggtggtcccccattcccgggaggtcagcatattgatgccaaacttagtgcggacacccgatcggcataacgcatgcagcccaggactcctgggctcaagcagtcctcccgggctcaagcagtcctcccacctaagcctcccgcgtagctgagactacagacacttgccaccacaccaggttaatttttgtgttttttgtagaggtggggttttgccatgttgtccagactcatctcaaacttctcagctcaagtgagcctcctgcctcagcttcccaagtagctgggattatagacgcatgccaccacaccccatgataattgcctttttttttaatttgcataattttctttgtagcttttgctaatgttcccatatcttcttatagccttacagaatgattttccacaagatcagtgagtgctgtccagtagacatataatacaacccacatacatgattttacctttttttgtagccatagtaaaaaaggtcaaaagaagcagatgaaattaatagtatcttttacttaacccagttcattcaaaatgttatttcaataaatggtcaatatttaaaatacttgagatattttgcttttatttatttcttttgttactaagtcttcaaaatccaatgtgtattttacacttacagaacatctctttttagactggccacatgtagctcagggttactgtattggacagagtggtttcagtttcaagtttttccttggagacatcctacttgaaatttccattctccatgtatctgggtggttggtctatagacttgccactcacagctgtcatcttgagactttctttgcttttcttctctattggatattcagtttcctggatttcaggtcttctcattttcctctagtagttttgttaggtcatggttggtatggcatggttgggatagcgtgttcacacagctatctcgtgagtcatactcctccaatccagcctgctcgcttcccgtgtctgtcatgtagttgtcaccctgctatctctccctccagtttttgcagaaatttcctttgtcttcactcttggtcttcctctcccatcccccatgtatcctatatctttctctttcttggtttatttcatcactcaggtggaaaagatgctccagtggattactgggaaaagggggagcatggatgataaaggtattgagaccttacacgtcagggaatttttttttttttttttttttgagacggagttttgctcttgtccaggttggagtgcagtggcgccaactcggctcactgcaacctccacctcctgggttcaagtgattctcctgcctcagcctcctgagtagctgggattacaggtgcccgccaccacgcccagctaattttttgtatttttaatagagacgaggtttcactgtgttggccaggctggtcttgaactcctacttcaggcaatccacccacctcggaatgtttttattgtcccttctcatttcatgactgctgggctaggtatagaattccagaatcattgttcttagaatctcgaaggcattgcttcattgctggccagctttcagtgttcttgcaaagtctgaagctgtgctaatcacctcatcctttgaaagtgaactgttttttcttcccagaaacttacagaacattctctttgtccgcagaattctgggattgcaattactgtgccttagaatgggtctgtttttatcattatgaagagtactggatgggtcgggaggttttcttgaattacttcttgatgttttctttccttgtatttttttgtttgctaattttctatttttttttcttggtttactttcttgggcagggggatttcttctacttatatttgattcttcagttgagcttgtcatttttgctatcttgtttttaagtttcgagagacatctttgttttatataacattctgttcttaatacatagatgcaagatcttttctttctgagtatattaatatgtatttgaaatctttctattctctgcagtttgtttcccccaagggtttttttttttttctggtttttgttttttgtttttatgttagagactttcctgttatatctggtcatcagtggtacctgcatgtggtggagagtaggggcttattggagtatgagaaccttgagcaggtgtaaggagcctgtcaacactgcgctggcctcagggcctctagggaggctgccagttgtgcattctgaggataccttttggttgtgccttttgtctggtcagattatctagagatgctctgcctcctacctggaggagaagggtctagctgccagcggtgtgagtgtctcttggggaaaaggactcgagttcctggtgtttggcttgtgtatggccgcttaccccatttttggtggagcgctcacatcttccactgtgccaacagtcttgctgcagttcatagaccttctggtttacatttttccagaaagtatgtctttagatttctgcagaagtctgaggagcatggaaggagcttggggaatgagatggcaatccaggtcttcccagatggctctacctttatcccctgcagggaatcccactcctccttcctgactgggagcacagccagagccttgggaggaatctggagtggaaatctcgggcggtctggctttcttactgttcacttgtaattttgctttctcacaactgccaaccactaatcagcctgatttccagcttccagaattctattgctgttgtctgctctcctattcccaccgtaggggatggggctgtctttttttttttttttaattttggtaaaacatacaaaacataaagtgttccattttagccatttttaggtacacagttcagtggcagtaagtacattcacgttgtgtgtatttgtttttttagtaataaacaatataaaattttttaagtaataaaacacaaataaaagattgtttaatgtgattatcgtggaattttaggtgtgatcaggagccatggtgtagtcttctgttgaaacagggtgataggatttgtttaccacctcctaggaaagcagttggatagtttgttggcataaaagtacattttatctatttttaataatcgtagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataagctgcttagcccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaaaaaaaaaaaaagttattccagggaaacaattctccaactttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgaggtgagttgtttgcccagagtcacccagtgctgtttgaacccactcacataaccaaccaataccattatgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatatactttcagtgtttgggcttaaattctctttcaagtgtctttgtgatatgctctgaattttaaaaatttagaatcattgaagttcattatacttgaactttaaaaaaaaaaaacaaaaacctcgtataaaggtcaaggtatgacttcatgctgctgtgtacttaggtcatttaatcttcaaaccactggatagaggttaggttgaagttcgatcttaaatcctacctactgtagctcattgtaccagcaacagctgtagggactaggtggaattcatggtgggttttgttcccttttaaagattgaagccaccatattttctgccctctaaaagtttatgtcagccaggcatgggtggctcacacttgtaatcccagcactttggggaggctgaggtgggtggatcacttgaggccaggagttcgagaccagcctggccaacatggtgaaaccccatctctactaaaaatagaaaaattaggtgagcatggtggcctgcgcctgtaatcccagctactcgggaggctgaggcaggagaaacatttgaatccgggagatggaggctgcagtgagctgagaacatgccactgcactccagcctgggtgacagagtgagactcttgactcaaaaaaaaaagttatgcatcagagaacagatcctttgatgccctcctctgccctgaaaggtttttgggggagagtaataagtatcacaacaagatatgacctgagaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatggctttaggccacagggcgattttgaacatttgtaattttgcttaataattaggaaattaaaattctggggaagacagaatgctctatgaagaaaggctgctttgagcaaggagctaggtcagggcgcgttcaactgaggcctttcttcactgcctttttgtcttgtcccagttcctccccatttatgactaaaatcagcccagatgcttctcgtcatctgggatgcagagcatcagcccagctgtgttcagtcctatggggccattgagtaagttcttggtgcatggatacagggcaggcctttaccaggccctgagcccctggtcctcccagcacctctggggtatttaggggaggctgatgggggagggggttgataaggcgggagatgtctggggatgaggttgaggcaaaagtgacttcttgaggactttgctttttggagaagtcaaatttcctacttcttgatttcagcccttcaactctggtatggagtcaggaagccctttaaatacctgttgtcgggtgtatcatgtcaagtgttgcattagcaaatgaccatgtatccttgtgctactgtcctgcctaccccgcatcctagcgcttccttgggacatgagaagctctgtctggtttgtgaggtggcactggggatgttgagaaactgtttacacagtttccctttgccctggggatttactaaaggagtcgaggcagcctgaccccaaagcatcacccctggacactatgaccgaaacatttccccagtgcccaaaccaagaacacccttcccatttttttttcagtggtgttcattatgtaataatacaagtctctcttctcattttttaaaagtcagaagtacagaagagcagagaataatgtccaaggggccctccttcacctcccccgtgcagtgtcagctaagtgtggtgcgtgtccttgcagatcttaggggattgtgatccttcagaccattctaaactggggtggtgctgggagttagggaaggcatgaagggagtagtggagagctgcagtgactggggtcttcatgccagggtggagaatgcaaggcccaggtggccagccatgtgccacgggatttctggctgccaagagctgtttatctgttcactggggagggaagagttaaatgtggtctgcttttctccgagtcccttcagcacagggagtgctgacttgtcttgttcaggtagtaagttcaagatgagctcaggaaagaaagtgagaggacactgagggctagtggttgagccaagtgtgatgggacttaaagggagaagatttaaagaataaggagcttatgggccggggacggtggcttacgcctgtaatcccagcactttgggaggctgaagcaggtggatcacttgggtcaggagttcgaggccagcctggccaacatggtgaaaccccgtctctactaaaaatacagaaattagctgggtgtggtagtgtgcacctgtaatcccagctacttgggaggctgagacaggagaatcgcttgagcccaggaggcagaggttgcagtgagccaggattgcgcccctgtactccagcctgggtgatggagcgagactctgcctcaaaaaaaattaaaaaaaaataaagaggttaggtgaaaatagatgagaatggaaaccatgagaagaagtgatgctggccaaggacatgacaggttctgatgtggaggtgataggcaatgtctcttccagccactgctaataattgagacaaactcaaggcattcataccctgtgtccagtaaacatctgtgcccattgccaggtgagctggattgaaatgggccagctgctcagcagacaccctcatgccccagtgactctgttccccttgggccacctcattgaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccacgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgtctgattttttggctggtgagagtgtggctacctctgcggagctgtgggagcggctgactagatgagatttgcctccattcagtacctagactcttgccctgccacacctcttcggagtgagcattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagctgagaatagccgatttctgggcagccggcctcctgtgtagactgtcctgtgtagactgtcctgtgtagattgtctgtgtagactgtcctgtgtagattgtctgtgtagactgtcctgtgtagactgtccatgtaaactgtcctgtgtagattgtctgtgtagactgtcctgtgtagactgtcctgtgtagattgtctgtgtagactgtctctgtagaccgtcgtgtatagactgtcctgtgtagactgtctctgtagaccgtcgtgtatagactgtcctgtgtagactgtctctgtagaccgtcctgtgtagattgtctgtgtagaccatcctgtgtagaccatcccatttagaccatctgcctgtgcaggcgcaggccagtgttcagcagggccacaggctcctcggcctccctgccctcgctgctccccaacactgccaaccctgctgcggggtccaggaggagatgggctgaggatcgtggagaccagcaggagcgtgtggcccaggagcagggaactgggtgtccttgggccttgccaggtccaggctcagctaggacacggctctcacagctgtcctggttgcctccggccacagaagaaggtgagggctccagagaggccacctttccaaaaaaagcacagtcatggccctagaatgtaaaaaatccaagtgttaagaaggaacacatcaaaggaaacttcagcagtgaaaacttgaagcattaaccacgaagcctctgcctccaccacacacaaagaaacggctttagttactcgcagaaagtcttcctcttaggacagcgcgtgtttaaaatcataggggtttggtttgttttgttttggggttggggttttttgggggttttttacccttgcctactttttaaaaaatgaaagtgtttatttgcccaacaataacagacagggagcttgcctaagtgttctgttgatgatataatgtatcttgtcttagaaaaaaactttttcagtgaaaggtggtttttaaattttttcttccctccttagtagcttgattagtaaaatgtgaagttacaaatgtgaagcaaacccccacccttcaccactagtcagcaattttgagtaaagaaacaaagcatcaggtgctcacagcacacactgtcttagagggaaggggaagcctggtggcctgtggaagccttcagcatagctccatctgcaggcttctgaccctcagcactactgacacttgggctggatcattgtctgctagggatccgggcagggagtggctgtgctgggcgctgtaggaagtttagcagcatctctggcctctatccaccagatgccagtagcaccccctccccagatgtggcagtcagatgtgtttctgtctagactccagactttgtccaacgtcccctggtaggccaaattgcccccggttgagaaccaccgctctagatggtattgagggttgggaattttaaatcaagacatttattcagaaattaccagatatagtagcatttgcttcttatttatttctttgttgctaagtgtttggcaaaacctctttgctgtgagcacaaggtttgctttagcaattgttgtcacattacagcaaggagtggtgtccagcgctgtagttatgtatttgagcagtgtccagtgctgtagttatgtgttccagcctcaccaggccctgtgcttcattgtctcccactcaagactgaccacaaatggcccacagatccactgtgacaacctttccctttgggttactgtggtggcatcgagaacatggctggttggctttgctgtagtttactgtgataactgtgccagcagtccctgctttcctttgttaagtatcccattccactggaggattacttgggcgtgcagattggcatgaaaagcaatgtatggtttgagattgttaaagtttctttgggatcaacattttcaattctgtatcagcattatccctcccagagggctggctgggagaaatcatgagaagttacagtatcttatttgctcagctaatctaattataaatgatccacacagcttgtggtaaaaccagcttttggggagttttcatttaatgcatacttgtcttctgatttccttccttcaccaaatagtgtaggatgctccctcttatttttggcaaacatgcctgttatcttttgggaccctgggcttcctggaaaccagttatgcagaagatgattgtgtgtgttagactggggtcatccagatggctagagttctcactggttctgtttaaggattgactttagacacctcagtgtaggctgcaccatggcgtaagggttgggattgttgtttagaagggggaagtaagcaaggtgagtttaattggccattgcagaatctcacccgtatctccctcctgaaatcctcactaaagctgccgtttgctttcaggtgctttcatgcacaagacactgcattttgtatcacagggtccatataattcatttttctctcgtacttagttctctgtgttaagaattacttacttagttctctgtgttaataatttttggcgaaaccaaattacccgtcacagggttactgtagatgtctttcataggttttccaaacaccacttgcccacttgtttgggaaggccccaaggactgtttaacatctgccttcatggtggaaacagcaactatgagagatgctagcatgttggcactgccatgttcctctggtaccagcccaagataggactcaatttgaggcctggtgaagtactgtgttctaataaaaatccatctacttttcatggccgtatatatcaatgtaatagggtaactggaaatgtgatcttgtgccttttaaaaattttgtgtgtttaaaacaaaaatttctattggaaatgacagagcatagcttgttgctgtagacacctgagagtccttaaaaataaatattgggttattgacacttagttgcatgacagaattcctcacttgtacagttccaaagtcttagtctttacccagattacagagggttattaagcattaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagcctgtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccaccttactagctcatcacagtgtctccgtttcctcttctgtcaaactcaggttttgcgagggttctgggaggtcctatacgggaagggttagcagttaccatgggtgtgtagcacgggctttatctgaagggaaggtggagccgtagggagaccatgtggagtggggctccagggctgtgtgggtggggagggatctgcttctgggttaccccatgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactctagcctgggtgacagagcaagaccctgtctcaaaaataaataaataaaaaaaatagtagaagtaagatctagaatgtagcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatatggataccattttctagagaggaaagaatgatggaattgcctagtgtgagtctagcaattatcctaacatacacaaatttctccttgttctgtgccaagatactgtatttaatatttaatgaacattaaatattatttactagtgtatttaatggctgaggcagggttaaatatgtattattttcatcccagcagagttgggggaggtcctagtaactatgccatgagctctgtgagggtgaggtggtgtctttgcccccgcctccctggcacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagtgagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggtcagcattgcctttgtttgaatccaggtgtgaccattttaacttttttgtctttgaaggaggctgtcagttgtaaaagttcaaacaccgtctggtgtcaggggaaatagctacccttcatgtttaaaatagctagaaagttgtcaaaatgttcaccatgttgcactttgtgcctttgaagtgctcacatagagagcattgataggaagacgagactttattttcaaaagatttcatcttccaagtacatggctgcagccctgagaggccgagagcccctcgccaagccgtcacctctgctcatgcaaagggatttcctgacaaaccagccgaagtgaacactaataggacttcctcttgctgctctttcaaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaaggtaatatgattgggtcccagcttgttggggtgaggggaaatgactttctgttctagaaacacacgctggtactgaaaccctgtggatgcagcctcctgttggcaagcagcgcttccgcatccttggggaacagggcgcgtggaccacagccactccactcctggctgctggaggtccggtattgggcacagggtggccgcaggacatgagccacttctgtgggcttctagtgccaccttgtggtgcttgttggaatgaggggctcggagccaccgagtagggtttttctgccccccctgacgacagcgccctcccccaggtttccggacagtcctgaaatgtgatgtccaggcttgagtgccctcagtccccacagtggtcctttggggaatgtaaccttttttatgtggtcttgattaaatcccattttacttccttgcaggttaacaaccattattgagtacctattgatatgtgtggtgtactgagttaactagaacatgtcccctggtctgtgttctagaccatcttgctgggaaaaaggcagacccaaagcatattttggtgggggcccatggacagtgatgtgatagaggtgtccgctgaggtggtcagggaaggctgcttgcagtaggtggccgtgcacggaaagtttgcagaatgagcaggtgttagttccagctggagatgactgccggctgtgcccttggtacctgctttctggagggaagttttaagacgtgtgcatacttgacccagcagttgtatacatggagaaatttactttgcagcaactctcaaaacaagcgtgtaaagatgtgtataggtagttgtgtttgttgtggcattgtttgtagtagtgaaaaattagagacaggccaatgatataaccagggacctgatcaattatgttctctcccggtgttgggatattctgtagctcttaaagaatgagatctgggtgtactgatgtggccagacattgcaattgcagtacatgagaaggcaaatcatacagtagtgtgtacaccagtgagtcctccagccagataaatcctcacagtgaccagtcgcccaggcaccttgtgaaccctaccctgggtgtgggtgctatctgaagtacctgggggagggggtgacaagtggacttcaggctgatgtgggccctggcctggccctccctccaagcagagggggctggctcgctggaaggttaacatcatccaactctgtctacacgtggcttgttttttcctagaattcctgccacaatagcagcatccttgccattcattttctccaaagtgagtaacccatctctgccctctgattcctcagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtgacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaagtgatttttttgactttttgaagtaattttggacttgcaaaatgttgccaaaatagtacgaagagttccccagtaccctcgaagtttcctcgactgtttcaaagctggctgcaggcccaggctcatgagactgggaagaggacaggctgtggtcatgtggacccacaggggcctggggctgcagaagtcagtgtggcttccaccatttcaggtataaaaaagggcatctaagctttcaagaagagggaggatgctctagggcagcggtccccaaccttttctggcaccaggaaccggttccatggaagacaattttttcacaggcctgggggtggtgagggatggttttgggatagaaacttccacctcagatcatcaggcatcagattctcataaggagcttgcaacctgatctcttgcacacattcagttcacaatagggttcacgctcctaagagaacctgatgctgcagctgatctaacaggagatggagctcaggtggtcatgctcagtcgctcgccactcacctcctgccatgcagtccagttcctaacaggcctcagaccagtaccggtctgtggcctgggggttgaggacccctgctctaggctggtactgctgatgcttaaaaagagagggtttgccagaaatcagatgggacaaaagggcaaaggccgtgccacagagtgcccatataggggagagcacgcctggagccttcgagagcatgcagagaagcctggagactgcatttaccggagctgctgcctgaggccaccctccaagtgtccccacagcgcaccacaagaccacaggagtgacctcctcactggcaggtatttggggaaacaactgctgtctactcttttgggtaaaaagtgaaacaccaatagtttaattgaaatttcagaaaattgaacatatgaacaaggcaaataaatactaagtaagttaaaaacacaaaatatgtccaggaagtatcgatgagaatgttcaagttaaagttctccaatgccattgctacagcaacctcaaaccctaggttctctctgcactattaacacagacatctcaggacatggtttgcttttttttaagacttaaataggaaactaatttttctttctttaaagcaattgcgttcttcagtgaactctttctttaggccagttgatggcttcttagcagtttattgacgagatcctagggtagcttccgaagctgggttgattgattgcatttgggtgcggatggccaaagtgagtggccctactgcctgtgctgctcagggctcctgggctgatgtggtggct

SEQ ID NO: 15 - DNA, 4978 bp, Homo sapiens
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtaaaaa

SEQ ID NO: 16 - DNA, 938 bp, Homo sapiens
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaagacacattctgtaaaaaaaaaaaa

SEQ ID NO: 17 - DNA, 16 bp, Artificial sequence
  Synthetic oligonucleotide
ttgatttaatggttgc

SEQ ID NO: 18 - DNA, 16 bp, Artificial sequence
  Synthetic oligonucleotide
tgatttaatggttgca

SEQ ID NO: 19 - DNA, 16 bp, Artificial sequence
  Synthetic oligonucleotide
gatttaatggttgcaa

SEQ ID NO: 20 - DNA, 16 bp, Artificial sequence
  Synthetic oligonucleotide
agtcgcgactctggta

SEQ ID NO: 21 - DNA, 16 bp, Artificial sequence
  Synthetic oligonucleotide
gtcaatatcaaagcac

SEQ ID NO: 22 - DNA, 16 bp, Artificial sequence
  Synthetic oligonucleotide
gaacattattaggcta

SEQ ID NO: 23 - DNA, 16 bp, Artificial sequence
  Synthetic oligonucleotide
ccttatggatgctgct

SEQ ID NO: 24 - DNA, 16 bp, Artificial sequence
  Synthetic oligonucleotide
cattgtactatgccag

SEQ ID NO: 25 - DNA, 20 bp, Artificial sequence
  Synthetic oligonucleotide
tgctccgttggtgcttgttc

SEQ ID NO: 26 - DNA, 20 bp, Artificial sequence
  Synthetic oligonucleotide
tcttcctgtgacagtggtgg

SEQ ID NO: 27 - DNA, 20 bp, Artificial sequence
  Synthetic oligonucleotide
ttcttcctgtgacagtggtg

SEQ ID NO: 28 - DNA, 20 bp, Artificial sequence
  Synthetic oligonucleotide
ggttcttcctgtgacagtgg

SEQ ID NO: 29 - DNA, 20 bp, Artificial sequence
  Synthetic oligonucleotide
cgactatgcgagtgtggtgt

SEQ ID NO: 30 - DNA, 20 bp, Artificial sequence
  Synthetic oligonucleotide
ccgactatgcgagtgtggtg

SEQ ID NO: 31 - DNA, 20 bp, Artificial sequence
  Synthetic oligonucleotide
gcctcagtctgcttcgcacc

SEQ ID NO: 32 - DNA, 20 bp, Artificial sequence
  Synthetic oligonucleotide
agcttcttgtccagctttat

SEQ ID NO: 33 - DNA, 20 bp, Artificial sequence
  Synthetic oligonucleotide
agcatagttaacgagctccc

SEQ ID NO: 34 - DNA, 20 bp, Artificial sequence
  Synthetic oligonucleotide
tgtcatattcctggatcctt

SEQ ID NO: 35 - DNA, 16 bp, Artificial sequence
  Synthetic oligonucleotide
ggacacccacgccccc

SEQ ID NO: 36 - DNA, 20 bp, Artificial sequence
  Synthetic oligonucleotide
ccctcctgtgcctggatgct

SEQ ID NO: 37 - DNA, 16 bp, Artificial sequence
  Synthetic oligonucleotide
gctaaacaaccgcctt

SEQ ID NO: 38 - DNA, 20 bp, Artificial sequence
  Synthetic oligonucleotide
atgcatggtgatgcttctga

SEQ ID NO: 39 - DNA, 16 bp, Artificial sequence
  Synthetic oligonucleotide
catggtgatgcttctg

SEQ ID NO: 40 - DNA, 16 bp, Artificial sequence
  Synthetic oligonucleotide
agagctaaacaaccgc

SEQ ID NO: 41 - DNA, 16 bp, Artificial sequence
  Synthetic oligonucleotide
actcccgggacaccca

SEQ ID NO: 42 - DNA, 16 bp, Artificial sequence
  Synthetic oligonucleotide
acaccctcgcctccgg

SEQ ID NO: 43 - DNA, 16 bp, Artificial sequence
  Synthetic oligonucleotide
gcctccggaacaccca

SEQ ID NO: 44 - DNA, 20 bp, Artificial sequence
  Synthetic oligonucleotide
acggcattggtgcacagttt

SEQ ID NO: 45 - DNA, 20 bp, Artificial sequence
  Synthetic oligonucleotide
gcaaccgggatgatgagtgc

SEQ ID NO: 46 - DNA, 20 bp, Artificial sequence
  Synthetic oligonucleotide
tgcacagtttctggcaggcc

SEQ ID NO: 47 - DNA, 20 bp, Artificial sequence
  Synthetic oligonucleotide
ggcagcggacggcattggtg

SEQ ID NO: 48 - DNA, 20 bp, Artificial sequence
  Synthetic oligonucleotide
ggtgcacagtttctggcagg

SEQ ID NO: 49 - DNA, 20 bp, Artificial sequence
  Synthetic oligonucleotide
gcagccatggtgatcaggag

SEQ ID NO: 50 - DNA, 20 bp, Artificial sequence
  Synthetic oligonucleotide
ggtagaaatatagttgttcc

SEQ ID NO: 51 - DNA, 20 bp, Artificial sequence
  Synthetic oligonucleotide
ttcatgtgtctgcatcatgt

SEQ ID NO: 52 - DNA, 20 bp, Artificial sequence
  Synthetic oligonucleotide
gcatccagcgagcaccaaag

SEQ ID NO: 53 - DNA, 20 bp, Artificial sequence
  Synthetic oligonucleotide
agccatggtgatcaggaggc

SEQ ID NO: 54 - DNA, 20 bp, Artificial sequence
  Synthetic oligonucleotide
cagccatggtgatcaggagg

SEQ ID NO: 55 - DNA, 20 bp, Artificial sequence
  Synthetic oligonucleotide
gtctggattacagcataaac

SEQ ID NO: 56 - DNA, 20 bp, Artificial sequence
  Synthetic oligonucleotide
ggtctggattacagcataaa

SEQ ID NO: 57 - DNA, 20 bp, Artificial sequence
  Synthetic oligonucleotide
ccttggtctggattacagca

SEQ ID NO: 58 - DNA, 20 bp, Artificial sequence
  Synthetic oligonucleotide
ccttggtctggattacagca

SEQ ID NO: 59 - DNA, 20 bp, Artificial sequence
  Synthetic oligonucleotide
gtgcttgtccaggatgatgc

SEQ ID NO: 60 - DNA, 17 bp, Artificial sequence
  Synthetic oligonucleotide
ggttcccgaggtgccca

SEQ ID NO: 61 - DNA, 20 bp, Artificial sequence
  Synthetic oligonucleotide
tccacaggccacaggtgggc

SEQ ID NO: 62 - DNA, 20 bp, Artificial sequence
  Synthetic oligonucleotide
ctctttattgttggaggaca

SEQ ID NO: 63 - DNA, 20 bp, Artificial sequence
  Synthetic oligonucleotide
gcaaggctcggttgggcttc

SEQ ID NO: 64 - DNA, 17 bp, Artificial sequence
  Synthetic oligonucleotide
gggcaatgcagtcctgg

SEQ ID NO: 65 - DNA, 17 bp, Artificial sequence
  Synthetic oligonucleotide
gaaggtgacaccagcct

SEQ ID NO: 66 - DNA, 17 bp, Artificial sequence
  Synthetic oligonucleotide
gctcagcatccacaggc

SEQ ID NO: 67 - DNA, 21 bp, Artificial sequence
  Synthetic oligonucleotide
gggttcccgaggtgcccaatg

SEQ ID NO: 68 - DNA, 20 bp, Artificial sequence
  Synthetic oligonucleotide
gcagaggtgaagcgaagtgc

SEQ ID NO: 69 - DNA, 20 bp, Artificial sequence
  Synthetic oligonucleotide
aatggtttattccatggcca

SEQ ID NO: 70 - DNA, 20 bp, Artificial sequence
  Synthetic oligonucleotide
ggtttattccatggccattg

SEQ ID NO: 71 - DNA, 20 bp, Artificial sequence
  Synthetic oligonucleotide
aaatggtttattccatggcc

SEQ ID NO: 72 - DNA, 18 bp, Artificial sequence
  Synthetic oligonucleotide
aatggtttattccatggc

SEQ ID NO: 73 - DNA, 16 bp, Artificial sequence
  Synthetic oligonucleotide
ctatttggatgtcagc

SEQ ID NO: 74 - DNA, 20 bp, Artificial sequence
  Synthetic oligonucleotide
tcttggttacatgaaatccc

SEQ ID NO: 75 - DNA, 20 bp, Artificial sequence
  Synthetic oligonucleotide
cttggttacatgaaatccca

SEQ ID NO: 76 - DNA, 20 bp, Artificial sequence
  Synthetic oligonucleotide
ggaatactcttggttacatg

SEQ ID NO: 77 - DNA, 20 bp, Artificial sequence
  Synthetic oligonucleotide
tggaatactcttggttacat

SEQ ID NO: 78 - DNA, 20 bp, Artificial sequence
  Synthetic oligonucleotide
ttttattgtctctgcctgga

SEQ ID NO: 79 - DNA, 20 bp, Artificial sequence
  Synthetic oligonucleotide
gaatgttttattgtctctgc

SEQ ID NO: 80 - DNA, 20 bp, Artificial sequence
  Synthetic oligonucleotide
aggaatgttttattgtctct

SEQ ID NO: 81 - DNA, 20 bp, Artificial sequence
  Synthetic oligonucleotide
acaggaatgttttattgtct

SEQ ID NO: 82 - DNA, 16 bp, Artificial sequence
  Synthetic oligonucleotide
tggcaagcatcctgta

SEQ ID NO: 83 - DNA, 16 bp, Artificial sequence
  Synthetic oligonucleotide
ctcaatccatggcagc

SEQ ID NO: 84 - DNA, 16 bp, Artificial sequence
  Synthetic oligonucleotide
accaagtttcttcagc

SEQ ID NO: 85 - DNA, 13 bp, Artificial sequence
  Synthetic oligonucleotide
gcattggtattca

SEQ ID NO: 86 - DNA, 20 bp, Artificial sequence
  Synthetic oligonucleotide
ttcagcattggtattcagtg

SEQ ID NO: 87 - DNA, 16 bp, Artificial sequence
  Synthetic oligonucleotide
cagcattggtattcag

SEQ ID NO: 88 - DNA, 15 bp, Artificial sequence
  Synthetic oligonucleotide
cagcattggtattca

SEQ ID NO: 89 - DNA, 14 bp, Artificial sequence
  Synthetic oligonucleotide
agcattggtattca

SEQ ID NO: 90 - DNA, 12 bp, Artificial sequence
  Synthetic oligonucleotide
gcattggtattc

SEQ ID NO: 91 - DNA, 18 bp, Artificial sequence
  Synthetic oligonucleotide
cggcatgtctattttgta

SEQ ID NO: 92 - DNA, 20 bp, Artificial sequence
  Synthetic oligonucleotide
ggctaaatcgctccaccaag

SEQ ID NO: 93 - DNA, 20 bp, Artificial sequence
  Synthetic oligonucleotide
ctctagcgtcttaaagccga

SEQ ID NO: 94 - DNA, 20 bp, Artificial sequence
  Synthetic oligonucleotide
gctgcatgatctccttggcg

SEQ ID NO: 95 - DNA, 20 bp, Artificial sequence
  Synthetic oligonucleotide
acgttgaggggcatcgtcgc

SEQ ID NO: 96 - DNA, 19 bp, Artificial sequence
  Synthetic oligonucleotide
gggtctgcagcgggatggt

SEQ ID NO: 97 - DNA, 21 bp, Artificial sequence
  Synthetic oligonucleotide
gttactacttccacctgcctg

SEQ ID NO: 98 - DNA, 25 bp, Artificial sequence
  Synthetic oligonucleotide
tatccggagggctcgccatgctgct

SEQ ID NO: 99 - DNA, 20 bp, Artificial sequence
  Synthetic oligonucleotide
tcccgcctgtgacatgcatt

SEQ ID NO: 100 - DNA, 21 bp, Artificial sequence
  Synthetic oligonucleotide
cagcagcagagtcttcatcat

SEQ ID NO: 101 - DNA, 20 bp, Artificial sequence
  Synthetic oligonucleotide
gggacgcggcgctcggtcat

SEQ ID NO: 102 - DNA, 20 bp, Artificial sequence
  Synthetic oligonucleotide
ccacaagctgtccagtctaa

SEQ ID NO: 103 - DNA, 20 bp, Artificial sequence
  Synthetic oligonucleotide
ccgcagccatgcgctcttgg

SEQ ID NO: 104 - DNA, 14 bp, Artificial sequence
  Synthetic oligonucleotide
tcagtcatgacttc

SEQ ID NO: 105 - DNA, 20 bp, Artificial sequence
  Synthetic oligonucleotide
gctgattagagagaggtccc

SEQ ID NO: 106 - DNA, 20 bp, Artificial sequence
  Synthetic oligonucleotide
tcccatttcaggagacctgg

SEQ ID NO: 107 - DNA, 20 bp, Artificial sequence
  Synthetic oligonucleotide
cggtgcaaggcttaggaatt

SEQ ID NO: 108 - DNA, 20 bp, Artificial sequence
  Synthetic oligonucleotide
gcttcagtcatgacttcctt

SEQ ID NO: 109 - DNA, 21 bp, Artificial sequence
  Synthetic oligonucleotide
agcttcagtcatgacttcctt

SEQ ID NO: 110 - DNA, 21 bp, Artificial sequence
  Synthetic oligonucleotide
gcttcagtcatgacttcctta

SEQ ID NO: 111 - DNA, 21 bp, Artificial sequence
  Synthetic oligonucleotide
agcttcttgtccagctttata

SEQ ID NO: 112 - DNA, 15 bp, Artificial sequence
  Synthetic oligonucleotide
tcagtcatgacttca

SEQ ID NO: 113 - DNA, 21 bp, Artificial sequence
  Synthetic oligonucleotide
tggtaatccactttcagagga

SEQ ID NO: 114 - DNA, 15 bp, Artificial sequence
  Synthetic oligonucleotide
atcagtcatgacttc

SEQ ID NO: 115 - DNA, 20 bp, Artificial sequence
  Synthetic oligonucleotide
tggtaatccactttcagagg

SEQ ID NO: 116 - DNA, 21 bp, Artificial sequence
  Synthetic oligonucleotide
tgcttcagtcatgacttcctt

SEQ ID NO: 117 - DNA, 20 bp, Artificial sequence
  Synthetic oligonucleotide
cactgatttttgcccaggat

SEQ ID NO: 118 - DNA, 21 bp, Artificial sequence
  Synthetic oligonucleotide
cactgatttttgcccaggata

SEQ ID NO: 119 - DNA, 21 bp, Artificial sequence
  Synthetic oligonucleotide
aagcttcttgtccagctttat

SEQ ID NO: 120 - DNA, 20 bp, Artificial sequence
  Synthetic oligonucleotide
acccaattcagaaggaagga

SEQ ID NO: 121 - DNA, 21 bp, Artificial sequence
  Synthetic oligonucleotide
acccaattcagaaggaaggaa

SEQ ID NO: 122 - DNA, 21 bp, Artificial sequence
  Synthetic oligonucleotide
aacccaattcagaaggaagga

SEQ ID NO: 123 - DNA, 21 bp, Artificial sequence
  Synthetic oligonucleotide
tgcttcagtcatgacttcctt

SEQ ID NO: 124 - DNA, 21 bp, Artificial sequence
  Synthetic oligonucleotide
atggtaatccactttcagagg

SEQ ID NO: 125 - DNA, 21 bp, Artificial sequence
  Synthetic oligonucleotide
tcttggttacatgaaatccca

SEQ ID NO: 126 - DNA, 20 bp, Artificial sequence
  Synthetic oligonucleotide
attcactttcataatgctgg

SEQ ID NO: 127 - DNA, 21 bp, Artificial sequence
  Synthetic oligonucleotide
attcactttcataatgctgga

SEQ ID NO: 128 - DNA, 21 bp, Artificial sequence
  Synthetic oligonucleotide
atcttggttacatgaaatccc

SEQ ID NO: 129 - DNA, 20 bp, Artificial sequence
  Synthetic oligonucleotide
cagctttattagggacagca

SEQ ID NO: 130 - DNA, 21 bp, Artificial sequence
  Synthetic oligonucleotide
cagctttattagggacagcaa

SEQ ID NO: 131 - DNA, 21 bp, Artificial sequence
  Synthetic oligonucleotide
acagctttattagggacagca

SEQ ID NO: 132 - DNA, 16 bp, Artificial sequence
  Synthetic oligonucleotide
ttcagtcatgacttcc

SEQ ID NO: 133 - DNA, 20 bp, Artificial sequence
  Synthetic oligonucleotide
  misc_feature (1)..(5): bases at these positions are RNA
  misc_feature (16)..(20): bases at these positions are RNA
gcuucagtcatgactuccuu

SEQ ID NO: 134 - DNA, 21 bp, Artificial sequence
  Synthetic oligonucleotide
tgctccgttggtgcttgttca

SEQ ID NO: 135 - DNA, 14 bp, Artificial sequence
  Synthetic oligonucleotide
tgctacaaaaccca

SEQ ID NO: 136 - DNA, 15 bp, Artificial sequence
  Synthetic oligonucleotide
ccattgtcacactcc

SEQ ID NO: 137 - DNA, 20 bp, Artificial sequence
  Synthetic oligonucleotide
cggttagaagactcatcttt

SEQ ID NO: 138 - DNA, 30 bp, Artificial sequence
  Synthetic oligonucleotide
ctccaacatcaaggaagatggcatttctag

SEQ ID NO: 139 - DNA, 23 bp, Artificial sequence
  Synthetic oligonucleotide
  misc_feature (12)..(12): n is a, c, g, or t
gaatattaacanactgacaagtc

SEQ ID NO: 140 - DNA, 21 bp, Artificial sequence
  Synthetic oligonucleotide
  misc_feature (9)..(9): n is a, c, g, or t
  misc_feature (19)..(19): n is a, c, g, or t
cgttgatanttctgccatnct

SEQ ID NO: 141 - DNA, 19 bp, Artificial sequence
  Synthetic oligonucleotide
gccatggttttttctcagg

SEQ ID NO: 142 - DNA, 20 bp, Artificial sequence
  Synthetic oligonucleotide
cctgccctttgttctagttg

SEQ ID NO: 143 - DNA, 21 bp, Artificial sequence
  Synthetic oligonucleotide
gtcgccccttctccccgcagc

SEQ ID NO: 144 - DNA, 18 bp, Artificial sequence
  Synthetic oligonucleotide
ggaccctcctccggagcc

SEQ ID NO: 145 - DNA, 23 bp, Artificial sequence
  Synthetic oligonucleotide
accaggcgtctcgtggggcacat

SEQ ID NO: 146 - DNA, 18 bp, Artificial sequence
  Synthetic oligonucleotide
tctcccagcgtgcgccat

SEQ ID NO: 147 - DNA, 15 bp, Artificial sequence
  Synthetic oligonucleotide
gtgctccattgatgc

SEQ ID NO: 148 - DNA, 20 bp, Artificial sequence
  Synthetic oligonucleotide
tcagggcattctttccattc

SEQ ID NO: 149 - DNA, 20 bp, Artificial sequence
  Synthetic oligonucleotide
cgaaggaaacaatactccga

SEQ ID NO: 150 - DNA, 20 bp, Artificial sequence
  Synthetic oligonucleotide
gacagcagccgcagcagaaa

SEQ ID NO: 151 - DNA, 20 bp, Artificial sequence
  Synthetic oligonucleotide
tggaaaggcttatacccctc

SEQ ID NO: 152 - DNA, 20 bp, Artificial sequence
  Synthetic oligonucleotide
tcaaggaagatggcatttct

SEQ ID NO: 153 - RNA, 16 nt, Artificial sequence
  Synthetic oligonucleotide
guggcuaacagaagcu

SEQ ID NO: 154 - RNA, 25 nt, Artificial sequence
  Synthetic oligonucleotide
uuugccgcugcccaaugccauccug

SEQ ID NO: 155 - DNA, 18 bp, Artificial sequence
  Synthetic oligonucleotide
  misc_feature (1)..(4): bases at these positions are RNA
  misc_feature (15)..(18): bases at these positions are RNA
gcgugcctcctcacuggc

SEQ ID NO: 156 - DNA, 20 bp, Artificial sequence
  Synthetic oligonucleotide
ccttggccacgccggcatcc

SEQ ID NO: 157 - DNA, 20 bp, Artificial sequence
  Synthetic oligonucleotide
gtcacacttgctggcctgtc

SEQ ID NO: 158 - DNA, 20 bp, Artificial sequence
  Synthetic oligonucleotide
tggcagtggacacgggtccc

SEQ ID NO: 159 - DNA, 20 bp, Artificial sequence
  Synthetic oligonucleotide
actcaccgagcttcctggtc

SEQ ID NO: 160 - DNA, 3731 bp, Homo sapiens
gtccgatggggctctggtggcgtgatctgcgcgccccaggcgtcaagcacccacaccctagaaggtttccgcagcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaacaaaaaaaaaaaaaaaaaaaaa
